United States Patent 12,508,308 (INFLUENZA mRNA VACCINES) - sequence listing, part 53

SEQ ID NO: 207391 - RNA, 1413 nt, Artificial Sequence; identical to SEQ ID NO: 199656
  derived and/or modified sequence opt5 from neuraminidase__InfluenzaA__AHG96578

SEQ ID NO: 207392 - RNA, 1413 nt, Artificial Sequence; identical to SEQ ID NO: 199656
  derived and/or modified sequence opt5 from neuraminidase__InfluenzaA__AHG96590

SEQ ID NO: 207393 - RNA, 1413 nt, Artificial Sequence; identical to SEQ ID NO: 199656
  derived and/or modified sequence opt5 from neuraminidase__InfluenzaA__AHG96602

SEQ ID NO: 207394 - RNA, 1413 nt, Artificial Sequence; identical to SEQ ID NO: 199656
  derived and/or modified sequence opt5 from neuraminidase__InfluenzaA__AHG96614

SEQ ID NO: 207395 - RNA, 1413 nt, Artificial Sequence; identical to SEQ ID NO: 199656
  derived and/or modified sequence opt5 from neuraminidase__InfluenzaA__AHG96626

SEQ ID NO: 207396 - RNA, 1413 nt, Artificial Sequence; identical to SEQ ID NO: 199656
  derived and/or modified sequence opt5 from neuraminidase__InfluenzaA__AHG96638

SEQ ID NO: 207397 - RNA, 1413 nt, Artificial Sequence; identical to SEQ ID NO: 199656
  derived and/or modified sequence opt5 from neuraminidase__InfluenzaA__AHG96650

SEQ ID NO: 207398 - RNA, 1413 nt, Artificial Sequence; identical to SEQ ID NO: 199656
  derived and/or modified sequence opt5 from neuraminidase__InfluenzaA__AHG96662

SEQ ID NO: 207399 - RNA, 1413 nt, Artificial Sequence; identical to SEQ ID NO: 199656
  derived and/or modified sequence opt5 from neuraminidase__InfluenzaA__AHG96674

SEQ ID NO: 207400 - RNA, 1413 nt, Artificial Sequence; identical to SEQ ID NO: 199656
  derived and/or modified sequence opt5 from neuraminidase__InfluenzaA__AHG96686

SEQ ID NO: 207401 - RNA, 1410 nt, Artificial Sequence; identical to SEQ ID NO: 199480
  derived and/or modified sequence opt5 from neuraminidase__InfluenzaA__AHG96698

SEQ ID NO: 207402 - RNA, 1410 nt, Artificial Sequence; identical to SEQ ID NO: 199480
  derived and/or modified sequence opt5 from neuraminidase__InfluenzaA__AHG96710

SEQ ID NO: 207403 - RNA, 1410 nt, Artificial Sequence; identical to SEQ ID NO: 199480
  derived and/or modified sequence opt5 from neuraminidase__InfluenzaA__AHG96722

SEQ ID NO: 207404 - RNA, 1410 nt, Artificial Sequence; identical to SEQ ID NO: 199480
  derived and/or modified sequence opt5 from neuraminidase__InfluenzaA__AHG96734

SEQ ID NO: 207405 - RNA, 1410 nt, Artificial Sequence; identical to SEQ ID NO: 199480
  derived and/or modified sequence opt5 from neuraminidase__InfluenzaA__AHG96746

SEQ ID NO: 207406 - RNA, 1410 nt, Artificial Sequence; identical to SEQ ID NO: 199480
  derived and/or modified sequence opt5 from neuraminidase__InfluenzaA__AHG96758

SEQ ID NO: 207407 - RNA, 1410 nt, Artificial Sequence; identical to SEQ ID NO: 199480
  derived and/or modified sequence opt5 from neuraminidase__InfluenzaA__AHG96770

SEQ ID NO: 207408 - RNA, 1410 nt, Artificial Sequence; identical to SEQ ID NO: 199480
  derived and/or modified sequence opt5 from neuraminidase__InfluenzaA__AHG96782

SEQ ID NO: 207409 - RNA, 1410 nt, Artificial Sequence; identical to SEQ ID NO: 199480
  derived and/or modified sequence opt5 from neuraminidase__InfluenzaA__AHG96794

SEQ ID NO: 207410 - RNA, 1410 nt, Artificial Sequence; identical to SEQ ID NO: 199480
  derived and/or modified sequence opt5 from neuraminidase__InfluenzaA__AHG96806

SEQ ID NO: 207411 - RNA, 1410 nt, Artificial Sequence; identical to SEQ ID NO: 199480
  derived and/or modified sequence opt5 from neuraminidase__InfluenzaA__AHG96818

SEQ ID NO: 207412 - RNA, 1410 nt, Artificial Sequence; identical to SEQ ID NO: 199480
  derived and/or modified sequence opt5 from neuraminidase__InfluenzaA__AHG96830

SEQ ID NO: 207413 - RNA, 1410 nt, Artificial Sequence; identical to SEQ ID NO: 199480
  derived and/or modified sequence opt5 from neuraminidase__InfluenzaA__AHG96842

SEQ ID NO: 207414 - RNA, 1410 nt, Artificial Sequence; identical to SEQ ID NO: 199480
  derived and/or modified sequence opt5 from neuraminidase__InfluenzaA__AHG96854

SEQ ID NO: 207415 - RNA, 1410 nt, Artificial Sequence; identical to SEQ ID NO: 199480
  derived and/or modified sequence opt5 from neuraminidase__InfluenzaA__AHG96866

SEQ ID NO: 207416 - RNA, 1410 nt, Artificial Sequence; identical to SEQ ID NO: 199480
  derived and/or modified sequence opt5 from neuraminidase__InfluenzaA__AHG96878

SEQ ID NO: 207417 - RNA, 1410 nt, Artificial Sequence; identical to SEQ ID NO: 199480
  derived and/or modified sequence opt5 from neuraminidase__InfluenzaA__AHG96890

SEQ ID NO: 207418 - RNA, 1410 nt, Artificial Sequence; identical to SEQ ID NO: 199480
  derived and/or modified sequence opt5 from neuraminidase__InfluenzaA__AHG96902

SEQ ID NO: 207419 - RNA, 1410 nt, Artificial Sequence; identical to SEQ ID NO: 199480
  derived and/or modified sequence opt5 from neuraminidase__InfluenzaA__AHG96914

SEQ ID NO: 207420 - RNA, 1410 nt, Artificial Sequence; identical to SEQ ID NO: 199480
  derived and/or modified sequence opt5 from neuraminidase__InfluenzaA__AHG96926

SEQ ID NO: 207421 - RNA, 1410 nt, Artificial Sequence; identical to SEQ ID NO: 199480
  derived and/or modified sequence opt5 from neuraminidase__InfluenzaA__AHG96938

SEQ ID NO: 207422 - RNA, 1410 nt, Artificial Sequence; identical to SEQ ID NO: 199480
  derived and/or modified sequence opt5 from neuraminidase__InfluenzaA__AHG96950

SEQ ID NO: 207423 - RNA, 1410 nt, Artificial Sequence; identical to SEQ ID NO: 199480
  derived and/or modified sequence opt5 from neuraminidase__InfluenzaA__AHG96962

SEQ ID NO: 207424 - RNA, 1410 nt, Artificial Sequence; identical to SEQ ID NO: 199480
  derived and/or modified sequence opt5 from neuraminidase__InfluenzaA__AHG96974

SEQ ID NO: 207425 - RNA, 1410 nt, Artificial Sequence; identical to SEQ ID NO: 199480
  derived and/or modified sequence opt5 from neuraminidase__InfluenzaA__AHG96986

SEQ ID NO: 207426 - RNA, 1410 nt, Artificial Sequence; identical to SEQ ID NO: 199480
  derived and/or modified sequence opt5 from neuraminidase__InfluenzaA__AHG96998

SEQ ID NO: 207427 - RNA, 1410 nt, Artificial Sequence; identical to SEQ ID NO: 199480
  derived and/or modified sequence opt5 from neuraminidase__InfluenzaA__AHG97010

SEQ ID NO: 207428 - RNA, 1410 nt, Artificial Sequence; identical to SEQ ID NO: 199480
  derived and/or modified sequence opt5 from neuraminidase__InfluenzaA__AHG97022

SEQ ID NO: 207429 - RNA, 1410 nt, Artificial Sequence; identical to SEQ ID NO: 199480
  derived and/or modified sequence opt5 from neuraminidase__InfluenzaA__AHG97034

SEQ ID NO: 207430 - RNA, 1410 nt, Artificial Sequence; identical to SEQ ID NO: 199480
  derived and/or modified sequence opt5 from neuraminidase__InfluenzaA__AHG97046

SEQ ID NO: 207431 - RNA, 1410 nt, Artificial Sequence
  derived and/or modified sequence opt5 from neuraminidase__InfluenzaA__AHH00872
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaacaucaccggguucgcgcccuuuagcaaagacaauuccauucgccuuucugcuggaggcgauaucugggucacaagagagccuuaugugagcugugacccggauaagugcuaccaauucgcccuggggcagggaaccacacucaacaauggccauuccaacgacaccguucacgaucggacgcccuaucgcacacugcugaugaaugaacucggggugccuuuucaucugggaaccaagcaggucuguaucgccuggucuagcuccagcugccacgacggcaaagccuggcuucauguguguguuacaggcgaugacgagaacgcuaccgcuucuuucauuuacaaugggagacugguggauuccaucggaagcuggucuaagaaaauucuccggacccaggaauccgagugcgucuguaucaacggcacaugcacggugauuaugaccgacgggagcgccucuggaaaggcggauacaaaaauccuguuuaucgaggaaggcaagauugugcacaccagcccccuuuccggguccgcccaacacgucgaggaaugcucuuguuauccucgcuaccccggaguuagaugcgugugucgggacaacuggaagggcagcaaucgcccgaucguggauauuaacgucaaagacuacuccaucgugagcucuuauguuugcuccggccuggugggggacacaccuagaaagaaugauagcucuagcuccucucauugucucgaccccaacaaugaggaaggaggccacggggucaaaggaugggcuuucgaugacggcaacgauguguggauggggcggaccauuagcgagaagucccgcagcggauacgagacguuuaaaguuaucgaaggcuggucuaagccuaauuccaaacugcagaucaacagacaggugauuaucgaccggggcaaucgcagcggguauucuggaauuuucuccgucgagggcaagagcugcaucaacagauguuuuuacguggaacugauucgggggagaaagcaggagacagaaguccucuggaccuccaauucuaucgugguuuucugcggaaccagcggcacauaugggaccggcuccuggcccgauggagccgaccugaaccuuaugcccauuuga

SEQ ID NO: 207432 - RNA, 1416 nt, Artificial Sequence
  derived and/or modified sequence opt5 from neuraminidase__InfluenzaA__AHI43497
augaaccccaaucagaagcuguucgcccucagcggcguggcuaucgcccuguccauucuuaaccugcucaucgggauuucuaaugucggacugaacaucagccuucaccugaaaggcaaggggccuaaacaagaggaaaaucugaccugcacaacgauuaaccagaauaacaccacaguuguggagaauaccuacgugaacaauacaaccaucaucacaaaggaaaccgacuggaacacgccguccuaucuccugcucaauaaaucucuguguaacgucgagggaugggugguuauugcgaaggauaaugcuaucagauuuggcgaaagcgagcagauuaucgugacccgggagcccuacgucuccugcgacccuacaggguguaagauguaugcccuucaucagggaaccacaauucgcaacaaacacucuaacggcaccauccaugauagaacggccuuccggggccugauuagcacaccccucgggaccccucccacaguguccaauagcggauuuaugugcguuggcuggucuuccaccaccugucacgacgggaucggacgcaugacaaucugcauucaaggcaacaaugauaacgcuacggccaccguguacuauaaugggagacugacaaccacaaucaagaccugggcucggaacauucuucgcacgcaggaaagcgagugugucugccauaauggaacaugugccguggugaugaccgacggcucugcguccagccaggccuacaccaaagucauguauuuccacaagggccugguuaucaaagaagaggcucucagagggucugcccggcacauugaggaaugcuccuguuacggacauagccagcgcgugacaugcgugugcagagauaacuggcaaggcgcuaaucggccuaucaucgagauugacaugaacacccuggaacacacaucccgcuacgucuguacggggauccugaccgauacaucuagaccgggagacaagagcuccggcgauugcagcaaucccauuaccgggucuccuggagcccagggcgugaagggcuuuggguuccucaacggagacaauacauggcugggccggaccaucagcccccgcuccagaucuggguuugagaugcuuaaaauuccuaacgcgggaacggaucccaauagccggaucgccgaaagacaggagaucguugacaacaacaauugguccggcuauucugggagcuucauugacuacuggaacaauaacuccgaguguuauaauccgugcuuuuacguggaacugauccgcggccggccugaggaagcuaaguaugucugguggaccagcaacucucucauugcccuguguggaucccccuucccugugggcagcgggucuuuucccgauggagcucagauccaauacuucuccuga

SEQ ID NO: 207433 - RNA, 1410 nt, Artificial Sequence
  derived and/or modified sequence opt5 from neuraminidase__InfluenzaA__AHJ57439
augaaccccaaucagaagaucauuaccaucggcagcgugucccugauuaucucuacaauuugcuucuuuaugcaagucgccauccuccugacgaccguuacacuucacuucaaacaguacgaguuuaacagcccuccgaauaaccaggugaugcugugugaacccaccaucauugagagaaauaucacagaaauuguguaucucaccaacacaaccaucgagaaggaaauuugcccuaaacccgcugaguaccggaauugguccaagccucagugugacaucacgggguucgcccccuuuucuaaagauaacagcauucgccuguccgcgggaggcgacaucugggucaccagagagccuuaugugucuugcgauccggacaaguguuaccaauucgcucuugggcagggaacaacccugaauaacguucauagcaauaacacagugcgggaucgcacccccuauagaacgcuccugaugaaugaacugggcgucccuuuucaccucgggacaaaacaggugugcaucgccugguccucuagcuccugucaugacggaaaggccuggcugcacguuugcauuaccggcgaugacaagaacgcuacagccagcuucaucuacaauggccggcuuguggauucugucguguccuggagcaaagacauucugcgcacccaggagucugaaugugugugcaucaacgggaccuguacagucguuaugacggauggauccgcuagcggcaaggccgacaccaaaauucucuuuaucgaggaggggaagaucgugcauacauccacccugucuggaagcgcgcaacacguggaagagugcuccugcuaucccagauacccuggcguccggugugugugccgcgauaacuggaaggggagcaauagacccauuguugacaucaacauuaaagaccacucuaucguguccagcuacgucuguucuggacuugugggcgauacaccgcggaagaaugacagcuccucuagcucccauugccuggauccuaacaaugaagagggcgggcacggaguuaaaggcugggccuucgacgaugggaacgacguguggaugggacgcaccauuaaugaaacgagcagacucggcuaugagacauuuaaggucaucgagggguggucuaaccccaaauccaagcugcagaucaaucgccaggugauugucgaucggggaaacagaagcggcuacucuggcaucuucuccguggaagggaaaagcuguauuaaucggugcuuuuauguugagcugaucagaggacgcaaggaagagaccgaagugcucuggaccuccaacucuauugucguguucuguggcacaagcgggaccuacggaacaggcuccuggccugacggggcugauaucaaucugaugcccauuuga

SEQ ID NO: 207434 - RNA, 1410 nt, Artificial Sequence
  derived and/or modified sequence opt5 from neuraminidase__InfluenzaA__AHJ57440
augaaccccaaucagaagaucauuaccaucggcagcgugucccugauuaucucuacaauuugcuucuuuaugcaaaucgccauccucauuacgaccgucacacugcacuucaaacaguacgaguuuaacagcccuccgaauaaccagaugaugcuuugugaacccaccaucauugagagaaauaucacagaaauuguuuaucugaccaacacaaccaucgagaaggaaauuugcccuaaacccgcugaguaccggaauugguccaagccucagugugacaucacgggguucgcccccuuuucuaaagauaacagcauccgccucuccgcgggaggcgacauuugggugaccagagagccuuaugugucuugcgauccggacaaguguuaccaauucgcucuggggcagggaacaacccuuaauaacggccauagcaauaacacaguccgggaucgcacccccuauagaacgcugcucaugaaugaacugggggugccuuuucaccugggaacaaagcagguuugcaucgccugguccucuagcuccugucaugacggcaaagccuggcuccacgugugcauuaccggcgaugacaagaacgcuacagccagcuucaucuacaaugggcggcuggucgauucugugguuuccuggagcaaagagauucuucgcacccaggaaucugagugugugugcaucaacggaaccuguacagucgugaugacggacggcuccgcuagcgggaaggccgauaccaaaauccuguuuauugaggaaggaaagaucgugcauacauccacccucucuggcagcgcgcaacacgucgaggaaugcuccugcuaucccagauacccugggguucggugugugugccgcgacaacuggaagggaagcaauagacccauuguggauaucaacauuaaagaccacucuaucgucuccagcuacguguguucuggccugguuggcgacacaccgcggaagaaugauagcuccucuagcucccauugccuugacccuaacaaugaggaagggggacacggcgugaaagggugggccuucgaugacggaaacgaugucuggaugggccgcaccaucaaugagacgagcagacugggguaugagacauuuaaggugauugaaggauggucuaaccccaaauccaagcuccagaucaaucggcagguuauuguggaccgcggcgauagaagcggcuacucugggaucuucuccgucgagggaaaaagcuguauuaaccggugcuuuuauguggaacugaucagaggccgcaaggaggaaaccgagguccuguggaccuccaauucuauugugguuuucugugggacaagcggaaccuacggcacaggguccuggccugacggcgcugauaucaaccucaugcccaucuga

SEQ ID NO: 207435 - RNA, 1410 nt, Artificial Sequence
  derived and/or modified sequence opt5 from neuraminidase__InfluenzaA__AHJ57441
augaaccccaaucagaagaucauuaccaucggcagcgugucccugauuaucucuacaauuugcuucuuuaugcaaaucgccauccucauuacgaccgucacacugcacuucaaacaguacgaguuuaacagcccuccgaauaaccagguuaugcuuugugaacccaccaucauugagagaaauaagacagaaaucguguaucugaccaacacaaccauugagaaagaaaucugcccuaagcccgcugaguaccggaauugguccaaaccucagugugacauuacgggguucgcccccuuuucuaaggauaacagcauccgccucuccgcgggaggcgacaucugggugaccagagagccuuaugucucuugcgauccggacaaguguuaccaauucgcucuggggcagggaacaacccuuaauaacgugcauagcaauaacacaguucacgaucggacccccuaucgcacgcugcucaugaaugaacugggcgugccuuuucaucuggggacaaaacaggucugcauugccugguccucuagcuccugucacgacggaaaggccuggcuccaugugugcaucaccggcgaugacaaaaacgcuacagccagcuucauuuacaauggcagacugguugauucuguggucuccuggagcaaggagauccuucggacccaggaaucugagugugugugcauuaacgggaccuguacaguggucaugacggacggauccgcuagcggcaaagccgauaccaagauccuguuuaucgaggaagggaagauuguucacacauccacccucucuggaagcgcgcaacacguggaggaaugcuccugcuauccccgcuacccuggcgugagaugugucugccgggacaacuggaaagggagcaaucgccccaucguggauauuaacaucaaggaccauucuauuguuuccagcuacguguguucuggacuggucggcgacacaccgagaaagaaugauagcuccucuagcucccacugccuugacccuaacaaugaggaaggcgggcauggagugaagggcugggccuucgaugacgggaacgauguuuggaugggacggaccaucaaugagacgagccgccugggcuaugagacauuuaaagugaucgaaggguggucuaaccccaaguccaaacuccagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucuguggaccuccaacucuaucguggucuucuguggcacaagcgggaccuacggaacaggcuccuggccugauggggcugacauuaaucucaugcccaucuga

SEQ ID NO: 207436 - RNA, 1413 nt, Artificial Sequence
  derived and/or modified sequence opt5 from neuraminidase__InfluenzaA__AHJ57654
augaaccccaaucagaagauuaccugcaucagcgccacaggcaugacgcuguccguggucucucuccugaucgggauugcuaaccuuggacugaauaucggccuccacuacaaaguuagcgacuccaccaacauuaauaucccuaacaugaaugagacaucuccgaccacaaccaucauuaacaaucauccccaaaacaauuucacaaacaucaccaauauuaucaugaacaagaaugaagaggggaacuuucugaaccuuacgaaaccucugugugaagugaauagcuggcacauucucuccaaggauaacgccaucagaauuggagagaaugcgcauauccuggugacccgggaacccuaucugucuugcgacccucagggcugucgcauguucgcucucagccaggggacaacccugagaggacggcacgccaacggcacaauccaugaucgcucccccuuuagagcccuuauuagcugggagaugggccaggcuccuucuccguacaaugcccgggucgagugcaucgggugguccagcaccucuugucacgacggaauuucccgcaugagcaucugcauuucuggccccaacaauaacgcuuccgccgugguuugguaugggggaagaccugugacggaaauccccagcugggcgggcaauauccugcggacacaagaguccgaaugugucugccacgggggaauuuguccugugguuaugaccgauggccccgccaacaaucgcgcugagacaaaaaucauuuacuucaaggagggcaaggugcagaaaaucgaggaacucaaggggaacgcccagcauauugaagagugcucuuguuauggagcuagcggcaugaucaaaugcaucugcagagacaauuggaagggggccaaccggccggucauuaccaucgauccugaaaugaugacccacacauccaaauaccuguguagcaagauucuuacggacaccucucgccccaaugauccuacaaacggaaacugcgacgcgcccaucaccggcgggucccccgauccuggagugaagggcuuugccuuccuggacggcgagaauagcuggcucgggagaacaauuucuaaagauagccgguccggauaugagaugcugaagaucccgaacgcugaaaccgacacgcagucuggcgccauuagccaucaaaucaucgugaauaaccagaauugguccggguacagcggagcuuuuauugacuacugggccaacaaagaguguuucaaucccugcuuuuaugucgaacugauccgcggcagaccuaaggagucuuccguucucuggacaagcaacucuauuguggcccugugugggucccgggaaagacuuggcagcugguccuggcacgauggagcugagaucauuuacuucaaauga

SEQ ID NO: 207437 - RNA, 1410 nt, Artificial Sequence
  derived and/or modified sequence opt5 from neuraminidase__InfluenzaA__AHJ57666
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccgucgagaaagaaaucugcccuaaggugguugaguaucggaacugguccaaaccccaguguaagauuacgggguucgccccuuuuucuaaggacaauagcauccgccucuccgcgggaggcgauauuugggugaccagagagcccuacgucucuugcgggcugggaaaauguuaucaguucgcucuuggccaagggacaacccuggacaacagccacuccaauggaacaauccaugaucggaucccucaccgcacccuccugaugaacgaacugggcgugccguuucaucucggcacgaagcagguuugcauugccuggucuagcuccagcugucacgacgggagagccuggcugcacaucugcauuacaggagaugaccggaaugcuaccgccucuuucaucuacgauggcaugcuuguggacuccauugggagcuggucuaaaaacauccugcgcacacaggaguccgaaugugucugcaucaauggaaccugugcuguggugaugaccgauggcagcgccuccggggucgcggacacacggauucucuuuaucagagagggaaagauuguucauaucucuccccugagcggcuccgcccagcacauugaggaaugcagcugcuauccucgcuaccccgaugugagaugugugugccgggacaacuggaaaggcucuaaccgcccugucaucgauaucaauauggcugacuauuccauugacagcaacuacguguguucugggcuuguuggagauacgcccagaaaugacgauaacagcuccucuagcaauugccgggacccgaacaaugagcgcggcaacccuggggugaagggaugggccuucgaugacggcaaugaugucuggauggggagaaccaucaaccgggacuccagaagcggauacgaaacauuucgcgugauuggcggcuggaccacagcuaauucuaagucccaaaucaaccggcagguuauuguggauaauaacaauuggagcggguauucuggagucuucuccguggagggcaaaagcuguaucaacagaugcuuuuacgucgaacugauuaaggggcgcccccaggagccucgggugugguggaccuccaacucuaucguuguguucuguggaacgagcggcacauaugggaccggcuccuggcccgacggagccaauaucaacuuuaugcccauuuga

SEQ ID NO: 207438 - RNA, 1413 nt, Artificial Sequence
  derived and/or modified sequence opt5 from neuraminidase__InfluenzaA__AHJ57677
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaacaugaaugagacaucuccgaccacaaccgugaucaacaaucauccccaaaacaauuucacaaacauuaccaauaucauugugaacaagaaugaagaggaaaacuuucucaaccugacgaaaccucuuugugaggucaauagcuggcacauccuguccaaggauaacgccauuagaaucggggaaaaugcgcauauucucgugacccgggagcccuaucugucuugcgacccucagggaugucgcauguucgcucugagccagggcacaacccucagagggcagcacgccaacggaacaauccaugaucggucccccuuucgcgcccugaucagcugggagaugggccaagcuccuucuccguacaaugccagaguugaaugcauuggcugguccagcaccucuugucacgacgggaucucccggaugagcauuugcaucucuggacccaacaauaacgcuuccgccguggucugguauggcgggcgcccugugacggagauucccagcugggcgggaaauauccuuagaacacaggaauccgaguguguuugccacggcgggaucuguccuguggucaugaccgauggacccgccaacaaucgggcugagacaaaaauuaucuacuucaaggaaggcaagauucagaaaguggaggaacugaagggcaacgcccagcauaucgaggaaugcucuuguuauggggcuagcggaaugauuaaaugcaucugccgcgacaauuggaagggcgccaacagaccggugaucaccauugauccugagaugaugacccacacauccaaauaccucuguagcaagauccugacggacaccucucggcccaaugauccuacaaacgggaacugcgacgcgcccauuaccggaggcucccccgauccuggggucaagggauuugccuuccuugacggcgagaauagcuggcugggccgcacaaucucuaaagauagcagauccggguaugaaaugcucaagguuccgaacgcugagaccgacacgcaaucuggagccauuagccaucagaugaucgugaauaaccagaauugguccggcuacagcggggcuuuuauugacuacugggccaaaaaggaauguuucaaccccugcuuuuauguggagcugauccggggacgcccuaaagaaucuuccguccuguggacaagcaauucuaucguggcccucuguggcuccagagagcggcuggggagcugguccuggcacgauggcgcugagauuaucuacuucaaguga

SEQ ID NO: 207439 - RNA, 1413 nt, Artificial Sequence
  derived and/or modified sequence opt5 from neuraminidase__InfluenzaA__AHJ57689
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaagaugaacgagacaucuccgaccacaaccaucauuaauaaccauccccaaaauaacuucacaaauaucaccaacauuaucgugaauaaaaacgaagaggaaaauuuucucaaccugacgaagccucuuugugaggugaacagcuggcacauucuguccaaagauaaugccaucagaauuggggaaaacgcgcauauccucgucacccgggagcccuaucugucuugcgacccucagggaugucgcauguucgcucugagccagggcacaacccucagagggcagcacgccaauggaacaauccaugaucggucccccuuucgcgcccugauuagcugggagaugggccaagcuccuucuccguacaacgccagaguggaaugcaucggcugguccagcaccucuugucacgacgggauuucccggaugagcaucugcauuucuggacccaauaacaaugcuuccgccguugugugguauggcgggcgcccugucacggagauccccagcugggcgggaaacauccuuagaacacaggaauccgagugugugugccacggcgggauuuguccuguugugaugaccgauggacccgccaauaaccgggcugagacaaagaucauuuacuucaaggaaggcaaaauccagaagauugaggaacugaaaggcaaugcccagcauaucgaggaaugcucuuguuauggggcuagcggaaugaucaagugcauuugccgcgacaacuggaaaggcgccaauagaccggucaucaccauugauccugagaugaugacccacacauccaaguaccucuguagcaagauccugacggacaccucucggcccaacgauccuacaaaugggaacugcgacgcgcccauuaccggaggcucccccgauccuggggugaaaggauuugccuuccuugacggcgagaacagcuggcugggccgcacaaucucuaaggauagcagauccggguaugaaaugcucaaagugccgaaugcugagaccgacacgcaaucuggagccauuagccaucagaucaucgucaacaaucagaacugguccggcuacagcggggcuuuuauugacuacugggccaauaaggaauguuucaaccccugcuuuuauguugagcugauccggggacgcccuaaagaaucuuccgugcuguggacaagcaauucuauuguggcccucuguggcuccagagagcggcuggggagcugguccuggcacgauggcgcugagaucauuuacuucaaguga

SEQ ID NO: 207440 - RNA, 1413 nt, Artificial Sequence
  derived and/or modified sequence opt5 from neuraminidase__InfluenzaA__AHJ57700
augaaccccaaucagaagauuaccugcaucagcgccacaggcaugacgcuguccguggucucucuccugaucgggauugcuaaccuuggacugaauaucggccuccacuacaaaguuagcgacuccaccaacauuaauaucccuaacaugaaugagacaucuccgaccacaaccaucauuaacaaucauccccaaaacaauuucacaaacaucaccaauauuaucaugaacaagaaugaagaggggaacuuucugaaccuuacgaaaccucugugugaagugaauagcuggcacauucucuccaaggauaacgccaucagaauuggagagaaugcgcauauccuggugacccgggaacccuaucugucuugcgacccucagggcugucgcauguucgcucucagccaggggacaacccugagaggacggcacgccaacggcacaauccaugaucgcucccccuuuagagcccuuauuagcugggagaugggccaggcuccuucuccguacaaugcccgggucgagugcaucgggugguccagcaccucuugucacgacggaauuucccgcaugagcaucugcauuucuggccccaacaauaacgcuuccgccgugguuugguaugggggaagaccugugacggaaauccccagcugggcgggcaauauccugcggacacaagaguccgaaugugucugccacgggggaauuuguccugugguuaugaccgauggccccgccaacaaucgcgcugagacaaaaaucauuuacuucaaggagggcaaggugcagaaaaucgaggaacucaaggggaacgcccagcauauugaagagugcucuuguuauggagcuagcggcaugaucaaaugcaucugcagagacaauuggaagggggccaaccggccggucauuaccaucgauccugaaaugaugacccacacauccaaauaccuguguagcaagauucuuacggacaccucucgccccaaugauccuacaaacggaaacugcgacgcgcccaucaccggcgggucccccgauccuggagugaagggcuuugccuuccuggacggcgagaauagcuggcucgggagaacaauuucuaaagauagccgguccggauaugagaugcugaaggugccgaacgcugaaaccgacacgcagucuggcgccaucagccaucaaauuaucgucaauaaccagaauugguccggguacagcggagcuuuuaucgacuacugggccaacaaagaguguuucaaucccugcuuuuauguugaacugauucgcggcagaccuaaggagucuuccgugcucuggacaagcaacucuaucguggcccugugugggucccgggaaagacuuggcagcugguccuggcacgauggagcugagauuaucuacuucaaauga

SEQ ID NO: 207441 - RNA, 1410 nt, Artificial Sequence
  derived and/or modified sequence opt5 from neuraminidase__InfluenzaA__AHJ57710
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccgucgagaaagaaaucugcccuaaggugguugaguaucggaacugguccaaaccccaguguaagauuacgggguucgccccuuuuucuaaggacaauagcauccgccucuccgcgggaggcgauauuugggugaccagagagcccuacgucucuugcgggcugggaaaauguuaucaguucgcucuuggccaagggacaacccuggacaacagccacuccaauggaacaauccaugaucggaucccucaccgcacccuccugaugaacgaacugggcgugccguuucaucucggcacgaagcagguuugcauugccuggucuagcuccagcugucacgacgggagagccuggcugcacaucugcauuacaggagaugaccggaaugcuaccgccucuuucaucuacgauggcaugcuuguggacuccauuagcucuugguccaaaaacauccugcgcacacaggagagcgaaugugucugcaucaaugggaccugugcuguggugaugaccgauggauccgccucuggcgucgcggacacacggauucucuuuaucagagaggggaagauuguucauaucagcccccuguccggaagcgcccagcacauugaggaaugcucuugcuauccucgcuaccccgaugugagaugugugugccgggacaacuggaaaggcuccaaccgcccugucaucaauaucaacauggcugauuauagcauugacucuaauuacguguguagcggccuuguuggggacacgcccagaaacgaugacaauuccucuagcuccaacugccgggauccgaauaacgagcgcggaaauccuggcgugaaggggugggccuucgacgauggaaacgacgucuggaugggcagaaccaucaaucgggauagcagaucuggguacgaaacauuucgcgugauuggaggcuggaccacagcuaacuccaagagccaaaucaaucggcagguuauuguggacaacaauaacuggucuggcuauuccggggucuucagcguggagggaaaauccuguaucaacagaugcuuuuacgucgaacugauucgcggccggccccaggagccuagagugugguggaccucuaauagcaucguuguguucugugggacguccggaacauauggcaccgggucuuggcccgauggcgccaacaucaauuuuaugcccauuuga

SEQ ID NO: 207442 - RNA, 1410 nt, Artificial Sequence
  derived and/or modified sequence opt5 from neuraminidase__InfluenzaA__AHJ57734
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccgucgagaaagaaaucugcccuaagguggccgaguaucggaacugguccaaaccccaguguaagauuacgggguucgcgccuuuuucuaaggacaauagcauccgccucuccgcuggaggcgauauuuggguuaccagagagcccuacgugucuugcgggcugggaaaauguuaucaguucgcccuuggccaagggacaacccuggacaacagccacuccaauggaacaauccaugaucggaucccucaccgcacccuccugaugaacgaacugggcgucccguuucaucucggcacgaaacaggugugcauugccuggucuagcuccagcugucacgacgggagagcuuggcugcacaucugcauuacaggagaugaccggaaugccaccgcuucuuucaucuacgauggcaugcuuguugacuccauugggagcuggucuaagaacauccugcgcacacaggaguccgaaugugugugcaucaauggaaccugugccgucgugaugaccgauggcagcgcguccgggguggccgacacacggauucucuuuauccgggagggaaagauuguccauaucucuccccugagcggcuccgcucagcacauugaggaaugcagcugcuauccucgcuaccccgauguuagaugugugugccgggacaacuggaaaggcucuaaccgcccugugaucaauaucaacauggccgauuauuccauugacagcaauuacgucuguucugggcuugugggagacacgcccagaaacgaugacaauagcuccucuagcaacugccgggauccgaauaacgagcgcggcaauccugggguuaagggaugggcuuucgacgauggcaacgacguguggauggggagaaccaucaaucgggauuccagaagcggauacgaaacauuucgcgucauuggcggcuggaccacagccaacucuaagucccaaaucaauagacaggugauuguugacaacaauaacuggagcggguauucuggaguguucuccgucgagggcaaaagcuguaucaacagaugcuuuuacguggaacugauucgcgggcggccccaggagccuagagucugguggaccuccaauucuaucgugguuuucuguggaacgagcggcacauaugggaccggcuccuggcccgauggagcgaacaucaauuuuaugcccauuuga

SEQ ID NO: 207443 - RNA, 1380 nt, Artificial Sequence
  derived and/or modified sequence opt5 from neuraminidase__InfluenzaA__AHJ57746
augaaccccaaucagaagaucauuaccaucggcagcguguccauuacaaucgccgcugucugcuuccugaugcaaauugccauccucgcgacgaccguuacacugcacuuuaaacagaacgaguguaauaucccuucuaagaaccaugugauuccgugcgaacccaucauuaucgagagaaauauuaccgaaguggagauccggccuaaagucgcugaauaccgcgacuggagcaagccccagugucagauuacaggguucgccccuuuuuccaaagauaacucuaucagacuuagcgccggaggcaauaucugggugacccgggagcccuauguuuccugcgggccugacaaguguuaccaauucgcucugggacagggcacaacccucgggaacggacacucuaauggcacgauucaugauaagaucccgcaccgcacccugcuuaugaacgagcugggcgugcccuuucaucucgggacaaaacaggucugcauugccuggagcuccagcucuugucacgacggcagagcuuggcugcacgugugcguuaccggagaugaccggaaugccacagcguccuucaucuaugaugggaugcugguggacagcauugccucuuggucccagaacauccuccgcacccaagaaagcgagugugucugcaucaauggaacguguacaguggugaugaccgauggcucugcuuccggggucgccgacacacggauucuguuuauccgggaaggaaagauuguucauaucagcccucuuuccggcucugcucagcacauugaggagugcagcugcuacccccgccauuccgaugugagaugugugugccgggacaacuggaaaggcagcaaucgcccugucguggauaucaacaugaccgacuauucuaucgacuccagcuacguuuguucugggcuggugggagauacccccagaaacgacgauagcuccucuagcuccaauugccgggacccgaacaaugaacgcggcaacccuggggucaagggaugggccuucgaugacggcgaugacguguggauggggagaacaauuagccgggauucuagauccggauaugagacguuucgcguuaucggcggcuggaccacagcgaauagcaaaucucagauuaacagacaggugaucgucgacaauaacaauugguccggguacagcggaguguucuccgucgaaggcaagucuuguauuaacagaugcuuuuacguggagcucauccgcgggcggccccaagaaaccagaguuugguggacaagcaauuccauuguggucuucuguggaaccucuggcacguaugggacaggcagcuggccugauggagccaacaucaauuuuaugcccaucuga

SEQ ID NO: 207444 - RNA, 1410 nt, Artificial Sequence
  derived and/or modified sequence opt5 from neuraminidase__InfluenzaA__AHJ57758
augaaccccaaucagaagaucauuaccgugggcagcgucucccuggccaucgcuacaauuugccuccugaugcaaaucgccauucuugcgacgaccguuacacugcacuucaaacagaacgaguguaauaucccuucuaagaaccaggugaugccgugcgaacccaucauuaucgagagaaauauuaccgaaguggucuaccucaacaauacaaucauugagaaagaaaucuguccuaaggugguugaguaucggaacuggagcaaaccccagugccaaauuaccggguuugcuccuuucuccaaggacaauucuauccgccugagcgccggaggcgauaucugggugacaagagagcccuacgucuccuguucuccuagcaagugcuaucaguuugcccuugggcagggaaccacgcuggacaacucccauagcaauggcaccauucacgaucggaucccgcaucgcacacuccugaugaacgaacugggggugcccuuccaccucggaaccaaacagguuuguauugcuuggucuuccagcucuugccaugacggcagagccuggcugcacguguguaucacaggcgaugaccggaaugcuaccgccuccuuuauuuacaacgggaugcuugucgauagcaucucuuccuggagccgcaauauccugagaacgcaagaguccgaaugcguguguauuaacggaacaugcaccgugaucaugacagacggcucugcgagcggggucgccgauacccggauucucuucauccgcgagggaaacauuguucacguguccccucugagcggcucugcucagcauaucgaggaaugcuccuguuaucccagauacccugacgugcggugcgucugucgcgauaauuggaaggggagcaacagacccgugguugacaucaauauggccgauuauucuauugacagccacuacgugugcuccggacuugucggcgacaccccgcggaacgaugacucuagcuccagcucuaauuguaaagauccuaacaaugagcgcggcaaccccggggugaagggaugggcuuuugacgauggcaaugacguuuggauggggagaacaaucucccgggauagcagaucuggauacgaaacguuccgcgugauuggcggguggaccacagccaacuccaaaagccagaucaaucggcaggucauuguggacaacaauaacugguccggauauucuggcgucuuuagcguggagggcaaguccugcaucaauagauguuucuacguugaacugauucgcgggcggccucaagagaccagagugugguggacaucuaacagcaucgucguguuuugcggaaccuccggcacguaugggacaggaagcuggcccgauggcgcgaacaucaauuucaugcccauuuga

SEQ ID NO: 207445 - RNA, 1401 nt, Artificial Sequence
  derived and/or modified sequence opt5 from neuraminidase__InfluenzaA__AHJ57770
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauuaucauugagagaaacaccgugcaucucaauuccacaaccaucgaaaaggagauuuguccuaaaguggucgaauacaagaacuggucuaaaccccagugccaaaucacaggguucgcgccuuuuagcaaggacaauuccauucggcugucugcuggaggcgauaucugggugacccgcgagcccuauguuagcuguucccuggggaagugcuaccaguucgcccuuggacagggcacgacccugaaaaacaagcacagcaaugggacaacccaugacagaaucccucaccggacacuccugaugaacgagcugggagugccguuucaucucggcaccaaacaggucuguauugccuggucuuccagcucuugcuaugauggcaaggcuuggcugcacaucugugugacgggggacgauaaaaaugccacagcuuccauuaucuacgacggaaugcuuguugauagcauuggcucuugguccaagaacauccugcgcacccaagaaagcgagugcguguguaucaaugggacaugcgccgucgugaugaccgacggauccgcgucuggcaaggccgauacccggauucucuucaucagagaagggaaaauuaucaacauuagcccccuguccggaagcgcucagcacguggaggagugcucuuguuauccucgcuaccccgaagucagaugcguuugucgggacaacuggaagggcuccaaucgcccugugcuuuauaucaacauggccgauuacagcguggagucuagcuacgucugcuccggccuggugggggacacacccagaaaugaugacucuagcuccagcucuaacugucgggacccgaauaacgaacgcggagcuccuggcguuaaagggugggccuuugaugacggaaaugauguguggaugggcagaacgaucaagaacgacucccggagcggguaugagaccuuccgcgucgugaauggauggacaaccgcgaacucuaaaucccagauuaauagacagguuaucguggauagcgaaaacugguccggcuacucuggcauuuuuagcgucgaggggaagaauugcaucaaccgguguuucuauguggagcucauuagaggacgcccccaagaaccucgggucugguggacauccaauucuaucauuguguuuugcggcaccagcgggacguacggaacaggcuccuggcccgacggggccaacaucaacuuccugcccaucuga

SEQ ID NO: 207446 - RNA, 1410 nt, Artificial Sequence
  derived and/or modified sequence opt5 from neuraminidase__InfluenzaA__AHJ57782
augaaccccaaucagaagaucauuaucauuggcagcguuucccugaccaucgccacagucugcuuccucaugcaaauugcuauccuggccacgaccguuacacuucacuuuaaacagaacgaguguaauaucccuucuaagaaccagguggugccgugcgaacccauuaucauugagagaaauaucaccgaagucguguaccugaacaauacaaccauugagaaagaaaucuguccugcgguuguggaguaucggaacuggagcaagccccagugccaaauuaaaggguucgcuccuuuuuccaaggacaauucuauccgccucagcgccggaggcgauaugugggucacaagagagcccuacguguccuguucuccuagcaagugcuaucaguucgcccuggggcagggaaccacgcuugacaacaaucauuccaacggcaccauccacgaucggauuccgcaucgcacacugcucaugaaugaacuggggguucccuuucaccugggaaccaaacagguguguaucgcuuggucuagcuccagcugccaugacggcaaggccuggcuccacgucugugugacaggcgaugacagaaacgcuaccgccucuuucauuuacgaugggaugcugguggacuccaucggaagcuggucucaaaauauucuucggacgcaggaguccgaaugcgucuguaucaacggcacaugcaccguugugaugacagaugggagcgcguccggaaucgccgacacccgcauucuguuugugagagagggcaaaaucguccacauuucuccucucagcggguccgcucagcauaucgaggaaugcagcuguuauccccgguacccugaugugcgcugcguuuguagagacaacuggaagggaucuaaucggcccauuguggauaucaacauggccgacuauuccaucggcagcucuuacgucugcagcggccuggugggggacaccccgcgcaaugaugacagauucuccucuagcaacugucgggauccuaauuccgagcgcggaaaccccggcguuaaagggugggcuuuugacgauggagacgauguguggaugggcagaacaauuagccgggacucuagauccggguacgaaacguuccgcgucaucggaggcuggaccacagccaauagcaagucucagauuaaccggcaagugaucgucgauaauaacaauugguccggcuauagcgggguguuuuccguugagggaaagucuugcauuaacagauguuucuacguggaacuuauccgcggccggccucaggagaccagagucugguggacaagcaauuccauugugguguuuugcgggaccucuggaacguauggcacagggagcuggcccgacggcgcgaacaucaauuucaugcccaucuga

SEQ ID NO: 207447 - RNA, 1410 nt, Artificial Sequence
  derived and/or modified sequence opt5 from neuraminidase__InfluenzaA__AHJ57794
augaaccccaaucagaagaucauuaccgugggcagcgucucccuggccaucgcuacaauuugcuuccucaugcaaaucgccauucuggcgacgaccguuacacuucacuuuaaacagaacgaguguaauaucccuucuaagaaccaggugaugccgugcgaacccaucauuaucgagagaaauauuaccgaaguggucuaccugaacaauacaaucauugagaaagaaaucuguccuaaggugguugaguaucggaacuggagcaaaccccagugccaaauuaccggguucgcuccuuuuuccaaggacaauucuauccgccucagcgccggaggcgauaucugggugacaagagagcccuacgucuccuguucuccuagcaagugcuaucaguucgcccuggggcagggaaccacgcuugacaacucccauagcaauggcaccauucacgaucggaucccgcaucgcacacugcucaugaacgaacugggggugcccuuucaccugggaaccaaacagguuuguauugcuuggucuuccagcucuugccaugacggcagagccuggcuccacguguguaucacaggcgaugaccggaaugcuaccgccuccuucauuuacaacgggaugcuggucgauagcaucucuuccuggagccgcaauauccuuagaacgcaagaguccgaaugcguguguauuaacggaacaugcaccgugaucaugacagacggcucugcgagcggggucgccgauacccggauucuguuuauccgcgagggaaacauuguucacguguccccucucagcggcucugcucagcauaucgaggaaugcuccuguuaucccagauacccugacgugcggugcgucugucgcgauaauuggaaggggagcaacagacccgugguugacaucaauauggccgauuauucuauugacagccacuacgugugcuccggacuggucggcgacaccccgcggaacgaugacucuagcuccagcucuaauuguaaagauccuaacaaugagcgcggcaaccccggggugaagggaugggcuuccgacgauggccaugacguuuggauggggagaacaaucggacgggauagcagaucuggcuacgaaacguuccgcgugauugggggauggaccacagccaauuccaaaagccagaucaaccggcaggucauuguggacaauaacaauugguccggcuauucuggcgucuuuagcguggaggggaaguccugcaucaacagauguuucuacguugaacuuauucgcggacggccucaagagaccagagugugguggacaucuaauagcaucgucguguuuugcggcaccuccgggacguauggaacaggcagcuggcccgauggggcgaacaucaacuucaugcccauuuga

SEQ ID NO: 207448 - RNA, 1413 nt, Artificial Sequence
  derived and/or modified sequence opt5 from neuraminidase__InfluenzaA__AHJ57806
augaaccccaaucagaagauuaccugcaucagcgccacaggcaugacgcuguccguggucucucuccugaccgggaucgcuaaccuuggacugaauauuggccuccacuacaaaguuagcgacuccacaaacaucucuauuccuaauaugaacgaggccagcccgaccacaaccaucaucaauaaccauccccaaaauaacuucacaaauauuaccaacaucauuaugaauaagaacgaagaggggaauuuucugaaccuuacgaaaccucugugugaagugaacuccuggcacauccucucuaaggauaaugcgauuagaaucggagagaacgcucauauucuggugacccgggaacccuaucugagcugcgacccucagggcugucgcauguucgcccucucccaggggacaacccugagaggacggcacgccaauggcacaauccaugaucgcagccccuuuagagcucuuaucucuugggagaugggccaggccccuuccccguacaacgcucgggucgagugcauuggguggagcucuaccuccugucacgacggaaucagccgcaugucuauuugcaucuccggccccaauaacaaugccagcgcggugguuugguaugggggaagaccugugacggaaauucccuccugggccggcaacauccugcggacacaagagucugaaugugucugccacgggggaaucuguccugugguuaugaccgauggccccgcuaauaaccgcgccgagacaaaaauuaucuacuucaaggagggcaagauucagaaaaucgaggaacucaaggggaaugcucagcauauugaagagugcagcuguuauggagccuccggcaugaucaaaugcaucugcagagacaacuggaagggggcgaaucggccggugauuaccaucgauccugaaaugaugacccacacaagcaaauaccuguguucuaagauucuuacggacaccucccgccccaacgauccuacaaauggaaacugcgacgcccccaucaccggcgggagccccgauccuggagucaagggcuuugcuuuccuggacggcaaaaacucuuggcucgggagaacaauuagcaaggauucccggucuggauaugagaugcugaaagugccgaaugccgagaccgacacgcagagcggcgcuaucucccaucaaauuaucgugaacaaucagaacuggagcggguacucuggagccuuuaucgacuacugggccaauaaggaauguuucaaccccugcuuuuaugucgagcugauucgcggcagaccuaaagaauccagcguucucuggacaucuaauuccaucguggcucugugugggagccgggagagacuuggcuccuggucuuggcacgauggagcggaaauuaucuacuucaaguga

SEQ ID NO: 207449 - RNA, 1380 nt, Artificial Sequence
  derived and/or modified sequence opt5 from neuraminidase__InfluenzaA__AHJ57818
augaaccccaaucagaagauuaccugcaucagcgccacaggcgugacgcuguccgucguuucucuccugaucgggauugcuaaccuuggacugaauaucggccuccacuacaaagugagcgacuccccuaccauuaacaucccgaauaugaacgagacaaaucccaucaccacaaacauuaccaauaucauugugaacaagaaugaagaggggacauuccugaaccuuaccaaaccucugugugaagucaauucuuggcauauccucagcaaggauaacgccauuagaaucggagaggacgcgcacauucuggugacgcgggaacccuaucuguccugcgauccucaaggcugucgcauguuugcucucucucaggggaccacacugagaggacggcaugccaauggcaccauccacgaccgcagccccuucagagcccuuaucuccugggagaugggccaggcuccuagcccguacaacacacggguugagugcauuggguggucuuccaccagcugucaugauggaaucucucgcauguccauuugcaucagcggccccaacaauaacgccucugcuguggucugguauagagggcggccugugacggaaauucccuccugggccggaaauauccugcgcacacaggagagcgaauguguuugccacaaaggcaucuguccuguggucaugaccgacgggcccgcgaacaauaaggccgcuacaaagauuaucuacuuuaaagagggaaagauucagaaaaucgaggaacuccaaggcaacgcccagcacauugaggaaugcuccuguuauggcgcugccgggaugaucaagugcgugugcagagauaauuggaaaggagcgaaccggccgaucauuaccaucgacccugagaugaugacccauacaucuaaguaccuguguagcaagauucuuacggauaccucccgccccaaugacccuacagauggcaacugcgacgcccccaucaccgggggaagccccgauccuggcgugaaaggguucgcuuuucuggaaggagaaaauucuuggcucggcagaacaauuuccaaggacagccggucuggcuaugagaugcugaaagucccgaacgccgagaccgacacgcagagcggggcuaucucccaccaaaugauuguuaauaaccagaauuggucuggauacagcggcgccuucaucgauuacugggccaacaaggaguguuuuaaccccugcuucuauguggaacugauccgcgggagaccuaaagaguccagcgugcucuggacaucuaauuccauugucgcucuguguggaagccgggaaagacuuggcucuugguccuggcaugacggggcggagaucauuuacuuuaaguga

SEQ ID NO: 207450 - RNA, 1410 nt, Artificial Sequence
  derived and/or modified sequence opt5 from neuraminidase__InfluenzaA__AHJ57830
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccaucgagaaagaaauuugcccuaaggucguggaguaucggaacugguccaaaccccaguguaagaucacgggguucgccccuuuuucuaaggacaauagcauucgccucuccgcgggaggcgauaucuggguuaccagagagcccuacgugucuugcgggcugggaaaauguuaucaguucgcucuuggccaagggacaacccuggacaacagccacuccaauggaacaauccaugaucggauuccucaccgcacccuccugaugaacgaacugggcgucccguuucaucucggcacgaaacaggugugcaucgccuggucuagcuccagcugucacgacgggagagccuggcugcacauuugcaucacaggagaugaccggaaugcuaccgccucuuucauuuacgauggcaugcuuguugacuccaucgggagcuggucuaagaacauccugcgcacacaggaguccgaaugugugugcauuaauggaaccugugcugucgugaugaccgauggcagcgccuccgggguggcggacacaagaauccucuuuauucgggagggaaagaucguccauauuucuccccugagcggcuccgcccagcacaucgaggaaugcagcugcuauccucgcuaccccgauguuagaugugugugccgggacaacuggaaaggcucuaaccgcccugugaucgauauuaauauggcugacuauuccaucgacagcaacuacgucuguucugggcuugugggagauacgcccagaaaugacgauaacagcuccucuagcaauugccgggacccgaacaaugagcgcggcaacccugggguuaagggaugggccuucgaugacggcaaugauguguggauggggagaaccauuaaccgggacuccagaagcggauacgaaacauuucgcgucaucggcggcuggaccacagcuaauucuaagucccaaauuaacagacaggugaucguugauaauaacaauuggagcggguauucuggaguguucuccgucgagggcaaaagcuguauuaaccggugcuuuuacguggaacugauccgcgggcggccccaggagccuagagucugguggaccuccaacucuaucgugguuuucuguggaacgagcggcacauaugggaccggcuccuggcccgacggagccaauauuaacuuuaugcccaucuga

SEQ ID NO: 207451 - RNA, 1413 nt, Artificial Sequence
  derived and/or modified sequence opt5 from neuraminidase__InfluenzaA__AHJ57842
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaagaugaacgagacaaauccgaccacaaccaucauuaacaaucauccccaaaacaauuucacaaacaucaccaauauuaucgugaacaaaaaugaagaggaaaacuuucucaaccugacgaagccucuuugugaggucaauucuuggcacauucugagcaaagauaacgccaucagaauuggggaaaaugcgcauauccucgugacccgggagcccuaucuguccugcgacccucagggaugucgcauguucgcucugucucagggcacaaccaucagagggcagcacgccaacggaacaauucaugaucggagccccuuucgcgcccucaucuccugggagaugggccaagcuccuagcccguacaaugccagaguggaaugcauuggcuggucuuccaccagcugucacgacgggaucucucggauguccauuugcaucagcggacccaacaauaacgcuucugccguugugugguauggcgggcgcccugucacggagauccccuccugggcgggaaauauucugagaacacaggaaagcgagugugugugccacggcgggaucuguccuguugugaugaccgauggacccgccaacaaucgggcugagacaaagauuaucuacuucaaggaaggcaaaauucagaagaucgaggaacuuaaaggcaacgcccagcauaucgaggaaugcuccuguuauggggcuucuggaaugauuaagugcaucugccgcgacaauuggaaaggcgccaacagaccggucauuaccaucgauccugagaugaugacccacacaagcaaguaccuguguuccaagauucucacggacaccagccggcccaaugauccuacaaacgggaacugcgacgcgcccaucaccggagggucuuccgaucccggcgugaaaggauuugccuuccuggacggcgagaauagcuggcuuggccgcacaauuucuaaggauagcagauccggguaugaaaugcugaaagugccuaacgcugagaccgacacgcaaucuggagccaucagccaucagaucauugucaauaaccagaauugguccggcuacagcggggcuuuuaucgacuacugggccaacaaggaauguuucaauccgugcuuuuauguugagcucauucggggacgccccaaagaaucuuccgugcuguggacaagcaacucuaucguggcccuguguggcuccagagagcggcucgggagcugguccuggcacgauggcgcugagauuaucuacuucaaguga

SEQ ID NO: 207452 - RNA, 1413 nt, Artificial Sequence
  derived and/or modified sequence opt5 from neuraminidase__InfluenzaA__AHJ57853
augaaccccaaucagaagauuaccugcaucagcgccacaggcaugacgcuguccguggucucucuccugaucgggauugcuaaccuuggacugaauguuggccuccacuacaaagugaacgacccuaccaauaucaacauuccgaauaugaacgagacaagccccaccacaaccaucaucaauaaccauccucaaaauaacuucacaaauauuaccaacaucauugugaauaagaacgaagaggaaaacuuucugaaucuuacgaaaccccugugugaggucaacuccuggcacauccucucuaaggauaaugccauuagaaucggggaaaacgcgcauauucuggugacccgggagccuuaucugagcugcgacccccagggaugucgcauguucgcucucucccagggcacaacccugagagggcagcacgccaauggaacaauccaugaucggucuccuuuucgcgcccuuaucagcugggagaugggccaagcuccgucccccuacaacgccagaguugaaugcauuggcuggagcucuaccuccugucacgacgggaucagccggaugucuauuugcaucuccggaccuaauaacaaugcuagcgccguggucugguauggcgggcgccccgugacggagauuccuucuugggcgggaaacauccugagaacacaggaauccgaguguguuugccacggcgggaucugucccguggucaugaccgauggaccggccaauaaccgggcugagacaaaaauuaucuacuucaaggaaggcaagauucagaaaaucgaggaacucaagggcaaugcccagcauauugaggaaugcagcuguuauggggcuuccggaaugaucaaaugcaucugccgcgacaacuggaagggcgccaauagaccugugauuaccaucgaucccgagaugaugacccacacaucuaaauaccuguguagcaagauucuuacggacaccucccggccuaacgaucccacaaacgggaauugcgacgcgcccaucaccggaggcagcccugauccgggggugaagggauuugccuuccuggacggcgagaacucuuggcucggccgcacaauuuccaaagauagcagaucuggguaugaaaugcugaagguccccaaugcugagaccgacacgcaaagcggagccaucucccaucagaugauuguuaacaaucagaacuggucuggcuacagcggggcuuuuaucgacuacugggccaauaaagaauguuucaacccuugcuuuuauguggagcugauccggggacgccccaaggaauccagcgugcucuggacaucuaauuccauugucgcccuguguggcagcagagagcggcuugggucuugguccuggcacgauggcgcugagaucauuuacuucaaauga

SEQ ID NO: 207453 - RNA, 1413 nt, Artificial Sequence
  derived and/or modified sequence opt5 from neuraminidase__InfluenzaA__AHJ57865
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaagaugaacgagacaaauccgaccacaaccaucauuaacaaucauccccaaaacaauuucacaaacaucaccaauauuaucgugaacaaaaaugaagaggaaaacuuucucaaccugacgaagccucuuugugaggucaauucuuggcacauucugagcaaagauaacgccaucagaauuggggaaaaugcgcauauccucgugacccgggagcccuaucuguccugcgacccucagggaugucgcauguucgcucugucucagggcacaacccucagagggcggcacgccaacggaacaauccaugaucgcagccccuuuagagcccugauuuccugggagaugggccaggcuccuagcccguacaaugcccggguggaaugcaucggcuggucuuccaccagcugucacgacgggauuucucgcauguccaucugcauuagcggacccaacaauaacgcuucugccguugugugguauggcgggagaccugucacggagauccccuccugggcgggaaauauccuucggacacaagaaagcgagugugugugccacggcgggauuuguccuguugugaugaccgauggacccgccaacaaucgcgcugagacaaagaucauuuacuucaaggaaggcaaaauccagaagauugaggaacugaaaggcaacgcccagcauaucgaggaaugcuccuguuauggggcuucuggaaugaucaagugcauuugcagagacaauuggaaaggcgccaaccggccggucaucaccauugauccugagaugaugacccacacaagcaaguaccucuguuccaagauccugacggacaccagccgccccaaugauccuacaaacgggaacugcgacgcgcccauuaccggaggcucucccgauccuggggugaaaggauuugccuuccuugacggcgaaaauuccuggcugggcagaacaaucagcaaggauucucggagcggguaugagaugcucaaagugccgaacgcugagaccgacacgcaguccggagccauuucucaucaaaugaucgucaauaaccagaauuggagcggcuacuccggggcuuuuaucgacuacugggccaacaaggaauguuucaaucccugcuuuuauguugagcugauucgcggaagaccuaaagaaagcucugugcuguggacauccaacagcaucguggcccucuguggcucucgggagagacugggguccuggagcuggcacgauggcgcugagauuaucuacuucaaguga

SEQ ID NO: 207454 - RNA, 1413 nt, Artificial Sequence
  derived and/or modified sequence opt5 from neuraminidase__InfluenzaA__AHJ57876
augaaccccaaucagaagauuaccugcaucagcgccacaggcaugacgcuguccguggucucucuccugaucgggauugcuaaccuuggacugaauaucggccuccacuacaaaguuagcgacuccaccaacauuaauaucccuaacaugaaugagacaucuccgaccacaaccaucauuaacaaucauccccaaaacaauuucacaaacaucaccaauauuaucaugaacaagaaugaagaggggaacuuucugaaccuuacgaaaccucugugugaagugaauagcuggcacauucucuccaaggauaacgccaucagaauuggagagaaugcgcauauccuggugacccgggaacccuaucugucuugcgacccucagggcugucgcauguucgcucucagccaggggacaacccugagaggacggcacgccaacggcacaauccaugaucgcucccccuuuagagcccuuauuagcugggagaugggccaggcuccuucuccguacaaugcccgggucgagugcaucgggugguccagcaccucuugucacgacggaaaaucccgcaugagcauuugcaucucuggccccaacaauaacgcuuccgccgugguuugguaugggggaagaccuauuacggaaauccccagcugggcgggcaauauccugcggacacaagaguccgaaugugugugccacgggggaauuuguccugucgugaugaccgauggccccgccaacaaucgcgcugagacaaagaucauuuacuucaaggagggcaaaguucagaagaucgaggaacucaaagggaacgcccagcauauugaagagugcucuuguuauggagcuagcggcaugaucaagugcaucugcagagacaauuggaaaggggccaaccggccggugauuaccaucgauccugaaaugaugacccacacauccaaguaccuguguagcaagauucuuacggacaccucucgccccaaugauccuacaaacggaaacugcgacgcgcccaucaccggcgggucccccgauccuggagucaaaggcuuugccuuccuggacggcgagaauagcuggcucgggagaacaauuucuaaggauagccgguccggauaugagaugcugaaagugccgaacgcugaaaccgacacgcagucuggcgccaucagccaucaaauuaucgugaauaaccagaauugguccggguacagcggagcuuuuaucgacuacugggccaacaaggaguguuucaaucccugcuuuuaugucgaacugauucgcggcagaccuaaagagucuuccguucucuggacaagcaacucuaucguggcccugugugggucccgggaaagacuuggcagcugguccuggcacgauggagcugagauuaucuacuucaaguga

SEQ ID NO: 207455 - RNA, 1413 nt, Artificial Sequence
  derived and/or modified sequence opt5 from neuraminidase__InfluenzaA__AHJ57888
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaacaugaaugagacaucuccgaccacaaccaucacaaacaaucauccccaaaacaauuucaccaacauuacgaauaucauugugagcaagaacgaagaggaaaauuuucucaaccugaccaaaccucuuugugaggugaacuccuggcacauccugucuaaggauaaugccauuagaaucggggaaaacgcgcauauucucgucacacgggagcccuaucugagcugcgacccucagggaugucgcauguucgcucugucccagggcaccacacucagagggcagcacgccaauggaaccauccaugaucggagccccuuucgcgcccugaucucuugggagaugggccaagcuccuuccccguacaacgccagaguggaaugcauuggcuggagcucuacguccugucacgacgggaucagccggaugucuauuugcaucuccggacccaauaacaaugcuagcgccguugugugguauggcgggcgcccugucacagagauucccuccugggcgggaaacauccuuagaacccaggaaucugagugugugugccacggcgggaucuguccuguugugaugacagauggacccgccaauaaccgggcugagaccaaaauuaucuacuucaaggaaggcaagauucagaaaaucgaggaacugaagggcaaugcccagcauauugaggaaugcagcuguuauggggcuuccggaaugaucaaaugcaucugccgcgacaacuggaagggcgccaauagaccggucauuaccaucgauccugagaugaugacacacacgagcaaauaccucuguucuaagauucugaccgacacaucccggcccaacgauccuaccaaugggaacugcgacgcgcccaucacaggaggcagccccgauccuggggugaagggauuugccuuccuugacggcgagaacucuuggcugggccgcaccauuagcaaagauuccagaucuggguaugaaaugcucaaggugccgaaugcugagacggacacacaaagcggagccaucucccaucagaugauugucaacaaucagaacuggagcggcuacucuggggcuuuuaucgacuacugggccaauaaagaauguuucaaccccugcuuuuauguugagcugauccggggacgcccuaaggaauccagcgugcuguggaccucuaauuccauuguggcccucuguggcagcagagagcggcugggguccuggucuuggcacgauggcgcugagaucauuuacuucaaauga

SEQ ID NO: 207456 - RNA, 1413 nt, Artificial Sequence
  derived and/or modified sequence opt5 from neuraminidase__InfluenzaA__AHJ57900
augaaccccaaucagaagauuaccugcaucagcgccacaggcaugacgcuguccguggucucucuccugaucgggauugcuaaccuuggacugaauaucggccuccacuacaaaguuagcgacuccaccaacauuaauaucccuaacaugaaugagacaucuccgaccgccacaaucauuaacaaucauccccaaaacaauuucaccaacaucacaaauauuaucgugaacaagaaugaagaggaaaacuuuuucaaccuggcgaaaccucuuugugaggugaauagcuggcacauucuguccaaggauaacgcuaucagaauuggggaaaaugcccauauccucgucacccgggagcccuaucugucuugcgacccucagggaugucgcauguuugcccugagccagggcacgacccucagagggcagcacgcuaacggaacaauccaugaucggucccccuuccgcgcccugauuagcugggagaugggccaagcuccuucuccguacaaugccagaguggaaugcaucggcugguccagcaccucuugucacgacgggauuucccggaugagcaucugcauuucuggacccaacaauaacgcguccgccguugugugguauggcgggcgcccugucacagagauccccagcugggcuggaaauauccuuagaacccaggaauccgagugugugugccacggcgggauuuguccuguugugaugacggauggacccgccaacaaucgggcugagacaaaaaucauuuacuuuaaggaaggcaagauccagaaaauugaggaccugaagggcaacgcccagcauaucgaagagugcucuuguuauggggcgagcggaaugaucaaaugcauuugccgcgauaauuggaagggcgccaacagaccggucaucaccauugacccugaaaugaugacacacaccuccaaauaccucuguagcaagauccugaccgauacaucucggcccaaugacccuacgaacgggaacugcgaugcucccauuaccggaggcucccccgacccuggggugaagggauucgccuuucuugauggcgagaauagcuggcugggccgcacaaucucuaaagacagcagauccggguaugagaugcucaaggugccgaacgcugaaaccgacacacaaucuggagccauuagccaucagaugaucgucaauaaccagaauugguccggcuacagcggggccuucaucgauuacugggcuaacaaagaguguuuuaaucccugcuucuauguugaacugauucggggacgcccuaaggagucuuccgugcuguggaccagcaacucuaucguggcgcucuguggcuccagagaacggcuggggagcugguccuggcacgacggcgccgagauuaucuacuuuaaauga

SEQ ID NO: 207457 - RNA, 1413 nt, Artificial Sequence
  derived and/or modified sequence opt5 from neuraminidase__InfluenzaA__AHJ57911
augaaccccaaucagaagauuaccugcaucagcgccacaggcgugacgcuguccgucguuucucuccugaucgggauugcuaaccuuggacugaauaucggccuccacuacaaagugagcgacuccucuaacauuaauaucccuaacaugaaugagaccaacccgacaaccacaaucauuaauaaccauacccaaaauaacuucaagaauaucacaaacauuaucgugaauaaaaacgaagaggggauuuuucugaaccuuaccaagccccugugugaagucaauagcuggcacauccucuccaaagauaacgccauuagaaucggagaggacgcgcauauccuggugacgcgggaaccuuaucugucuugcgauccccagggcugucgcauguucgcucucagccaggggaccacacugagaggacggcacgccaauggcaccauucaugaccgcuccccuuuuagagcccuuaucagcugggagaugggccaggcucccucuccuuacaacgcccggguugagugcauugggugguccagcacaucuugucacgauggaaucucccgcaugagcauuugcaucucuggcccgaauaacaaugcuuccgccguggucugguauagagggcggcccgugaccgaaaucccuagcugggcgggaaacauucugcgcacgcaagaguccgaauguguuugccacaagggcaucugucccguggucaugacagacgggccugccaauaacagagcugccaccaagauuaucuacuucaaagagggaaagauucagaaaaucgaggaacucaagggcaaugcucagcauaucgaggaaugcucuuguuauggcgccgcggggaugauuaaaugcaucugccgggauaacuggcgcggagccaauagacccgugauuacaaucgacccggagaugaugacccacaccagcaaguaccuguguuccaagauucuuacagauacgagccggccuaacgaccccaccaauggcaacugcgaugcuccuaucacagggggaucucccgaccccggcgugaaaggguuugccuuccuggauggagaaaacuccuggcucggccgcaccauuagcaaggacucuagaagcggcuaugagaugcugaaagucccuaaugcugagacagacacccaguccgggucuacgagcuaccaaaucaucguuaacaaucagaacugguccggauacagcggcgccuuuauugauuauugggccaauaaggaauguuucaacccgugcuuuuacguggagcugauccgggggagacccaaagaaucuuccgugcucuggacaagcaauucuauugucgcucuguguggaucccgcgagcggcuuggcagcugguccuggcaugacggggcggaaaucauuuauuucaaguga

SEQ ID NO: 207458 - RNA, 1410 nt, Artificial Sequence
  derived and/or modified sequence opt5 from neuraminidase__InfluenzaA__AHJ57923
augaaccccaaucagaagaucauuaccgugggcagcgucucccuggccaucgcuacaauuugcuuccucaugcaaaucgccauucuggcgacgaccguuacacuucacuuuaaacagaacgaguguaauaucccuucuaagaaccaggugaugccgugcgaacccaucauuaucgagagaaauauuaccgaaguggucuaccugaacaauacaaucauugagaaagaaaucuguccuaaggugguugaguaucggaacuggagcaaaccccagugccaaauuaccggguucgcuccuuuuuccaaggacaauucuauccgccucagcgccggaggcgauaucugggugacaagagagcccuacgucuccuguucuccuagcaagugcuaucaguucgcccuggggcagggaaccacgcuugacaacucccauagcaauggcaccauucacgaucggaucccgcaucgcacacugcucaugaacgaacugggggugcccuuucaccugggaaccaaacagguuuguauugcuuggucuuccagcucuugccaugacggcagagccuggcuccacguguguaucacaggcgaugaccggaaugcuaccgccuccuucauuuacaacgggaugcuggucgauagcaucucuuccuggagccgcaauauccuuagaacgcaagaguccgaaugcguguguauuaacggaacaugcaccgugaucaugacagacggcucugcgagcggggucgccgauacccggauucuguuuauccgcgagggaaagauuguucacguguccccucucagcggcucugcucagcauaucgaggaaugcuccuguuaucccagauacccugacgugcggugcgucugucgcgauaacuggaaagggagcaauagacccgugguugacaucaacauggccgauuauucuauugacagccacuacgugugcuccggacuggucggcgacaccccgcggaaugaugacucuagcuccagcucuaacuguaaggauccuaauaacgagcgcggcaaucccggggugaaaggaugggcuuucgacgauggcaacgacguuuggauggggagaacaaucucccgggauagcagaucuggauacgaaacguuucgcgugauuggcggguggaccacagccaauuccaagagccagaucaaccggcaggucauuguggacaauaacaauugguccggauauucuggcgucuucagcguggagggcaaguccugcaucaacagauguuuuuacguugaacuuauucgcgggcggccucaagagaccagagugugguggacaucuaauagcaucgucguguucugcggaaccuccggcacguaugggacaggaagcuggcccgauggcgcgaacaucaacuuuaugcccauuuga

SEQ ID NO: 207459 - RNA, 1380 nt, Artificial Sequence
  derived and/or modified sequence opt5 from neuraminidase__InfluenzaA__AHJ57935
augaaccccaaucagaagauuaccugcaucagcgccacaggcgugacgcuguccgucguuucucuccugaucgggauugcuaaccuuggacugaauaucggccuccacuacaaagugagcgacuccccuaccauuaacaucccgaauaugaacgagacaaaucccaccacaaccaacaucacaaauauuaucgugaacaagaaugaagaggggaccuuccugaaccuuacgaaaccucugugugaagucaauucuuggcauauucucagcaaggauaacgccaucagaauuggagaggacgcgcacauccuggugacccgggaacccuaucuguccugcgauccucaaggcugucgcauguuugcucucucucaggggacaacccugagaggacggcaugccaauggcacaauucacgaccgcagccccuucagagcccuuaucuccugggagaugggccaggcuccuagcccguacaacacccggguugagugcaucggguggucuuccacgagcugucaugauggaauuucucgcauguccaucugcauuagcggccccaacaauaacgccucugcuguggucugguauagagggcggccugugacagaaauccccuccugggccggaaauauucugcgcacccaggagagcgaauguguuugccacaaaggcaucuguccuguggucaugacagacgggcccgcgaacaauaaggccgcuaccaagaucauuuacuuuaaagagggaaagauccagaaaauugaggaacuccaaggcaacgcccagcacaucgaggaaugcuccuguuauggcgcugccgggaugauuaagugcgugugcagagauaauuggaaaggagcgaaccggccgaucaucaccauugacccugagaugaugacacauacgucuaaguaccuguguagcaagauccuuaccgauacaucccgccccaaugacccuaccaacggcaauugcgaugcccccauuacagggggaagccccgacccuggcgugaaaggguucgcuuuucuggauggagaaaacucuuggcucggcagaaccaucuccaaggacagccggucuggcuaugagaugcugaaagucccgaaugcccagacggacacacaaagcgggcccaccuccuaccagcugauuguuaacaaucagaacuggucuggauacagcggcgcuuucaucgauuauugggccaacaaggaguguuuuaauccuugcuucuacguggaacucauucgcgggagacccaaagaguccaacgugcuguggaccagcaauucuauggucgcccuuuguggaucccgggaaagacugggcagcuggucuuggcacgacgaugcugagaucaucuauuuuaaguga

SEQ ID NO: 207460 - RNA, 1410 nt, Artificial Sequence
  derived and/or modified sequence opt5 from neuraminidase__InfluenzaA__AHJ57946
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccgucgagaaagaaaucugcccuaaggugguugaguaucggaacugguccaaaccccaguguaagauuacgggguucgccccuuuuucuaaggacaauagcauccgccucuccgcgggaggcgauauuugggugaccagagagcccuacgucucuugcgggcugggaaaauguuaucaguucgcucuuggccaagggacaacccuggacaacagccacuccaauggaacaauccaugaucggaucccucaccgcacccuccugaugaacgaacugggcgugccguuucaucucggcacgaagcagguuugcauugccuggucuagcuccagcugucacgacgggagagccuggcugcacaucugcauuacaggagaugaccggaaugcuaccgccucuuucaucuacgauggcaugcuuguggacuccauugggagcuggucuaaaaacauccugcgcacacaggaguccgaaugugucugcaucaauggaaccugugcuguggugaugaccgauggcagcgccuccggggucgcggacacacggauucucuuuaucagagagggaaagauuguucauaucucuccccugagcggcuccgcccagcacauugaggaaugcagcugcuauccucgcuaccccgaugugagaugugugugccgggacaacuggaaaggcucuaaccgcccugucaucgauaucaauauggcugacuauuccauugacagccauuacguguguucugggcuuguuggagauacgcccagaaacgacgauaauagcuccucuagcaacugccgggacccgaauaacgagcgcggcaauccuggggugaagggaugggccuucgaugacggcaacgaugucuggauggggagaaccaucaaucgggacuccagaagcggauacgaaacauuucgcgugauuggcggcuggaccacagcuaacucuaagucccaaaucaaucggcagguuauuguggauaacaauaacuggagcggguauucuggagucuucuccguggagggcaaaagcuguaucaauagaugcuuuuacgucgaacugauucgcgggcggccccaggagccuagagugugguggaccuccaacucuaucguuguguucuguggaacgagcggcacauaugggaccggcuccuggcccgacggagccaacaucaauuuuaugcccauuuga

SEQ ID NO: 207461 - RNA, 1410 nt, Artificial Sequence
  derived and/or modified sequence opt5 from neuraminidase__InfluenzaA__AHJ57957
augaaccccaaucagaagaucauuaccaucggcagcgugucccugacaauugccacggucucuuuccucaugcaaaucgcuauucugaccacaaccguuacacuucacuuuaaacagaacgagugcaauaugccuccgaagaaccaggugaugagcugugaacccaucaucauugagagaaauaucaccgaaauuguguaccugaacaauacaaccgucgagaaagaaaucugcccuaaggugguugaguaucggaacugguccaaaccccaguguaagauuacgggguucgccccuuuuucuaaggacaauagcauccgccucuccgcgggaggcgauauuugggugaccagagagcccuacgucucuugcgggcugggaaaauguuaucaauucgcucuuggccaggggacaacccuggacaacagccauuccaauggaacaauccacgaucggaucccucaucgcacccuccugaugaacgaacugggcgugccguuucaccucggcacgaagcagguuugcauugccuggucuagcuccagcugucaugacgggagagccuggcugcacaucugcauuacaggagaugaccggaaugcuaccgccucuuucaucuacgauggcaugcuuguggacuccauugggagcuggucuaaaaacauccugcgcacacaggaguccgaaugugucugcaucaauggaaccugugcuguggugaugaccgauggcagcgccuccggggucgcggacacacggauucucuuuaucagagagggaaagauuguucacaucucuccccugagcggcuccgcccaacauauugaggaaugcagcugcuauccucgcuaccccgaugugagaugugugugccgggacaacuggaaaggcucuaaccgcccugucaucgauaucaauauggcugacuauuccauugacagcaacuacguguguucugggcuuguuggagauacgcccagaaaugacgauaacagcuccucuagcaauugccgggacccgaacaaugagcgcggcaacccuggggugaagggaugggccuucgauuacggcaaugacgucuggauggggagaaccaucaaccgggauuccagaagcggauaugaaacauuucgcgugauuggcggcuggaccacagcuaauucuaagucccagaucaaccggcagguuauuguggacaauaacaauuggagcggguacucuggagucuucuccguggagggcaaaagcuguaucaacagaugcuuuuaugucgaacugauucgcgggcggccccaggagccuagagugugguggaccuccaacucuaucguuguguucuguggaacgagcggcacauacgggaccggcuccuggcccgauggagccaauaucaacuuuaugcccauuuga

SEQ ID NO: 207462 - RNA, 1410 nt, Artificial Sequence
  derived and/or modified sequence opt5 from neuraminidase__InfluenzaA__AHJ57968
augaaccccaaucagaagaucauuaccgugggcagcgucucccuggccaucgcuacaauuugccuccugaugcaaaucgccauucuugcgacgaccguuacacugcacuucaaacagaacgaguguaauaucccuucuaagaaccaggugaugccgugcgaacccaucauuaucgagagaaauauuaccgaaguggucuaccucaacaauacaaucauugagaaagaaaucuguccuaaggugguugaguaucggaacuggagcaaaccccagugccaaauuaccggguuugcuccuuucuccaaggacaauucuauccgccugagcgccggaggcgauaucugggugacaagagagcccuacgucuccuguucuccuagcaagugcuaucaguuugcccuugggcagggaaccacgcuggacaacucccauagcaauggcaccauucacgaucggaucccgcaucgcacacuccugaugaacgaacugggggugcccuuccaccucggaaccaaacagguuuguauugcuuggucuuccagcucuugccaugacggcagagccuggcugcacguguguaucacaggcgaugaccggaaugcuaccgccuccuuuauuuacaacgggaugcuugucgauagcaucucuuccuggagccgcaauauccugagaacgcaagaguccgaaugcguguguauuaacggaacaugcaccgugaucaugacagacggcucugcgagcggggucgccgauacccggauucucuucauccgcgagggaaagauuguucacaucuccccucugagcggcucugcucagcauaucgaggaaugcuccuguuaucccagauacccugacgugcggugcgugugucgcgauaacuggaaagggagcaauagacccgucauugacaucaacauggccgauuauucuauugacagcaauuacgugugcuccggacuuguuggcgacaccccgcggaacgaugacaauucuagcuccagcaacugucgcgauccuaauaacgagagaggcaaucccggggugaagggaugggcuuuugacgauggcaacgacgucuggauggggcggacaaucaauagagauucucgcuccggauacgaaacguuccgggugauuggcggguggaccacagccaacagcaaaucucagaucaauagacagguuauuguggacaacaauaacugguccggauauagcggcgucuuuuccguggagggcaagucuugcaucaaccgcuguuucuacgucgaacugauccgggggagaccucaagagacccgcgugugguggacaagcaauuccauuguuguguuuugcggaaccucuuguacguauggcacagggagcuggcccgauggagcgaacaucaauuucaugcccauuuga

SEQ ID NO: 207463 - RNA, 1413 nt, Artificial Sequence
  derived and/or modified sequence opt5 from neuraminidase__InfluenzaA__AHJ57980
augaaccccaaucagaagaauaccugcaucagcgccauuggcaugacacuguccguggucucucuccugaucgggguugcugaccuuggacugaacauuggccuccacuacaaagugagcgauuccucuaacaucaauauuccuaacaugaaugagacgaacccgaccacaaccaucaucaauaacaauccccaaaacaauuucacaaacauuaccaauaucauugugaacaagaacgaagaggaaaaauuucugaaucuuacaaagccucugugugaggucaacagcuggcauauccucuccaaagacaaugccauuagaaucggggaagaugcgcacauucuggugacccgggagcccuaucugucuugcgacccucagggaugucgcauguucgcucucagccagggcacgacccugagagggcggcaugccaacggaacaauccacgaucgcucccccuuuagagcccuuaucagcugggagaugggccaggcuccuucuccguacaaugcccggguugaaugcauuggcugguccagcaccucuugucaugacgggaucucccgcaugagcauuugcaucucuggacccaacaauaacgcuuccgccguggucugguauggcgggagaccugugacagagauucccagcugggcgggaaauauccugcggacccaagaauccgaguguguuugccacaagggcaucuguccuguggucaugacggaugggcccgccaacaaucgcgcugccacaaagauuaucuacuucaaagagggaaagauucagaaaaucgaggaacucaagggcaacgcucagcacauugaagagugcucuuguuauggcgccgcggggaugaucaaaugcaucugcagagacaauuggaagggagccaaccggccggugauuaccaucgauccugaaaugaugacacauaccagcaaguaccuguguuccaaaauucuuaccgacacaagccgccccaaugauccuacgucuggcaacugcgacgcucccaucaccgggggaucccccgauccuggcgugaagggguuugccuuccuggacggagagaacagcuggcucggcagaacaauuucuaaagacagccgguccggcuaugagaugcugaaggucccgaaugcugaaaccgauacacagucugggcccaucagcuaccaaaccauuguuaacaaucagaacugguccggauacagcggcgccuuuaucgacuauugggccaauaaagaguguuucaacccuugcuuuuacguggaacugauccgcgggagacccaaggagucuuccgugcucuggacgagcaauucuauugucgcucuguguggaucccgggaaagacuuggcagcugguccuggcacgauggggcggagaucauuuauuucaaauga

SEQ ID NO: 207464 - RNA, 1410 nt, Artificial Sequence
  derived and/or modified sequence opt5 from neuraminidase__InfluenzaA__AHJ57992
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccgucgagaaagaaaucugcccuaaggugguugaguaucggaacugguccaaaccccaguguaagauuacgggguucgccccuuuuucuaaggacaauagcauccgccucuccgcgggaggcgauauuugggugaccagagagcccuacgucucuugcgggcugggaaaauguuaucaguucgcucuuggccaagggacaacccuggacaacagccacuccaauggaacaauccaugaucggaucccucaccgcacccuccugaugaacgaacugggcgugccguuucaucucggcacgaagcagguuugcauugccuggucuagcuccagcugucacgacgggagagccuggcugcacaucugcauuacaggagaugaccggaaugcuaccgccucuuucaucuacgauggcaugcuuguggacuccauugggagcuggucuaaaaacauccugcgcacacaggaguccgaaugugucugcaucaauggaaccugugcuguggugaugaccgauggcagcgccuccggggucgcggacacacggauucucuuuaucagagagggaaagauuguucauaucucuccccugagcggcuccgcccagcacauugaggaaugcagcugcuauccucgcuaccccgaugugagaugugugugccgggacaacuggaaaggcucuaaccgcccugucaucaauaucaacauggcugauuauuccauugacagcaauuacguguguucugggcuuguuggagacacgcccagaaacgaugacaauagcuccucuagcaacugccgggauccgaauaacgagcgcggcaauccuggggugaagggaugggccuucgacgauggcaacgacgucuggauggggagaaccaucaaucgggauuccagaagcggauacgaaacauuucgcgugauuggcggcuggaccacagcuaacucuaagucccaaaucaaucggcagguuauuguggacaacaauaacuggagcggguauucuggagucuucuccguggagggcaaaagcuguaucaacagaugcuuuuacgucgaacugauucgcgggcggccccaggagccuagagugugguggaccuccaauucuaucguuguguucuguggaacgagcggcacauaugggaccggcuccuggcccgauggagccaacaucaauuuuaugcccauuuga

SEQ ID NO: 207465 - RNA, 1413 nt, Artificial Sequence
  derived and/or modified sequence opt5 from neuraminidase__InfluenzaA__AHJ58004
augaaccccaaucagaagauuaccugcaucagcgccacaggcgugacgcuguccgucguuucucuccugaucgggauugcuaaccuuggacugaauaucggccuccacuacaaagugagcgacuccucuaacauuaauaucccuaacaugaaugagaccaacccgacaaccacaaucauuaauaaccauacccaaaauaacuucaagaauaucacaaacauuaucgugaauaaaaacgaagaggggaccuuucugaaccuuacgaagccccugugugaagucaauagcuggcacauucucuccaaagauaacgccaucagaauuggagaggacgcgcauauccuggugacccgggaaccuuaucugucuugcgauccccagggcugucgcauguucgcucucagccaggggacaacccugagaggacggcacgccaauggcacaauccaugaccgcuccccuuuuagagcccuuauuagcugggagaugggccaggcucccucuccuuacaacgcccggguugagugcaucgggugguccagcaccucuugucacgauggaauuucccgcaugagcaucugcauuucuggcccgaauaacaaugcuuccgccguggucugguauagagggcggcccgugacggaaaucccuagcugggcgggaaacauccugcgcacacaagaguccgaauguguuugccacaagggcauuugucccguggucaugaccgacgggccugccaauaacagagcugccacaaagaucauuuacuucaaagagggaaagauccagaaaauugaggaacucaagggcaaugcucagcauaucgaggaaugcucuuguuauggcgccgcggggaugaucaaaugcauuugccgggauaacuggcgcggagccaauagacccgugaucaccauugacccggagaugaugacccacacaagcaaguaccuguguuccaagauccuuacggauaccagccggccuaacgaccccacaaauggcaacugcgaugaaccuauuaccgggggaucucccgaccccggcgugaaaggguuugcuuuccuggauggagagaacuccuggcucggccgcacaaucagcaaggacucuagaagcggcuaugagaugcugaaagucccuaaugccgaaaccgacacgcaguccgggccgacaucuuaccaaauuaucguuaacaaucagaacuggagcggauacuccggcgcuuuuaucgauuauugggccaauaaggaguguuucaaccccugcuuuuacguggaacugauucgggggagaccuaaagagagcucugugcucuggaccuccaauagcaucgucgcccuguguggaucucgcgaacggcuuggcuccuggagcuggcaugacggggcugagauuaucuauuucaaguga

SEQ ID NO: 207466 - RNA, 1413 nt, Artificial Sequence
  derived and/or modified sequence opt5 from neuraminidase__InfluenzaA__AHJ58016
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaagaugaacgagacaaauccgaccacaaccaucauuaacaaucauccccaaaacaauuucacaaacaucaccaauauuaucgugaacaaaaaugaagaggaaaacuuucucaaccugacgaagccucuuugugaggucaauucuuggcacauucugagcaaagauaacgccaucagaauuggggaaaaugcgcauauccucgugacccgggagcccuaucuguccugcgacccucagggaugucgcauguucgcucugucucagggcacaacccucagagggcggcacgccaacggaacaauccaugaucgcagccccuuuagagcccugauuuccugggagaugggccaggcuccuagcccguacaaugcccggguggaaugcaucggcuggucuuccaccagcugucacgacgggauuucucgcauguccaucugcauuagcggacccaacaauaacgcuucugccguugugugguauggcgggagaccugucacggagauccccuccugggcgggaaauauccuucggacacaagaaagcgagugugugugccacggcgggauuuguccuguugugaugaccgauggacccgccaacaaucgcgcugagacaaagaucauuuacuucaaggaaggcaaaauccagaagauugaggaacugaaaggcaacgcccagcauaucgaggaaugcuccuguuauggggcuucuggaaugaucaagugcauuugcagagacaauuggaaaggcgccaaccggccggucaucaccauugauccugagaugaugacccacacaagcaaguaccucuguuccaagauccugacggacaccagccgccccaaugauccuacaaacgggaacugcgacgcgcccauuaccggaggcucucccgauccuggggugaaaggauuugccuuccuugacggcaaaaauuccuggcugggcagaacaaucagcaaggauucucggagcggguaugagaugcucaaggugccgaacgcugaaaccgacacgcaguccggagccauuucucaucaaaucaucgucaauaaccagaauuggagcggcuacuccggggcuuuuauugacuacugggccaacaaagaguguuucaaucccugcuuuuauguugaacugauccgcggaagaccuaaggagagcucugugcuguggacauccaacagcauuguggcccucuguggcucucgggaaagacugggguccuggagcuggcacgauggcgcugagaucauuuaccuuaaauga

SEQ ID NO: 207467 - RNA, 1413 nt, Artificial Sequence
  derived and/or modified sequence opt5 from neuraminidase__InfluenzaA__AHJ58028
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaagaugaacgagacaaauccgaccacaaccaucauuaacaaucauccccaaaacaauuucacaaacaucaccaauauuaucgugaacaaaaaugaagaggaaaacuuucucaaccugacgaagccucuuugugaggucaauucuuggcacauucugagcaaagauaacgccgugagaaucggggaagacgcgcauauucucgugacccgggagcccuaucuguccugcgauccucagggaugucgcauguucgcucugucucagggcacaacccucagagggcggcacgccaauggaacaauccaugaccgcagccccuuuagagcccugaucuccugggagaugggccaggcuccuagcccguacaacacccggguugaaugcauuggcuggucuuccacgagcugucacgaugggaucucucgcauguccauuugcaucagcggacccaauaacaaugccucugcuguggucugguauagaggccggccugugacagagauucccuccugggccgggaacauccuucgcacccaagaaagcgaguguguuugccacaagggaaucuguccuguggucaugacagacggccccgcgaauaacagagccgagaccaagauuaucuacuucaaagaagggaagauucagaaaaucgaggaacuggagggaaaugcucagcauauugaagagugcuccuguuauggcaccgccggcaugaucaagugcaucugccgggauaacuggcgcggggcuaauagaccggugauuacaaucgacccugagaugaugacgcacaccucucgguaccucuguagcaaaauucugacagauaccucccgccccaacgacccuacaaauggaaacugcgaugcccccaucaccggcgggagccccgacccuggagugaagggcuuugcguuccuugaugggaagaacucuuggcugggaagaacgauuuccaaagacagccggucuggcuaugaaaugcucaaggucccgaaugccgagacagacauccagagcggccccaccuccaaccaaauuaucguuaauaaccagaauuggucuggguacagcggagcuuuuaucgauuacugggccaacaaagaauguuucaauccuugcuuuuauguggagcugauuagaggccgccccaaggaauccaacgugcuguggaccagcaauucuaucgucgcucucugugggucccgggagagacugggaagcuggucuuggcaugacggcgccgagauuaucuacuucaaauga

SEQ ID NO: 207468 - RNA, 1410 nt, Artificial Sequence
  derived and/or modified sequence opt5 from neuraminidase__InfluenzaA__AHJ58040
augaaccccaaucagaagaucauuaccgugggcagcgucucccuggccaucgcuacaauuugccuccugaugcaaaucgccauucuugcgacgaccguuacacugcacuucaaacagaacgaguguaauaucccuucuaagaaccaggugaugccgugcgaacccaucauuaucgagagaaauauuaccgaaguggucuaccucaacaauacaaucauugagaaagaaaucuguccuaaggugguugaguaucggaacuggagcaaaccccagugccaaauuaccggguuugcuccuuucuccaaggacaauucuauccgccugagcgccggaggcgauaucugggugacaagagagcccuacgucuccuguucuccuagcaagugcuaucaguuugcccuugggcagggaaccacgcuggacaacucccauagcaauggcaccauucacgaucggaucccgcaucgcacacuccugaugaacgaacugggggugcccuuccaccucggaaccaaacagguuuguauugcuuggucuuccagcucuugccaugacggcagagccuggcugcacguguguaucacaggcgaugaccggaaugcuaccgccuccuuuauuuacaacgggaugcuugucgauagcaucucuuccuggagccgcaauauccugagaacgcaagaguccgaaugcguguguauuaacggaacaugcaccgugaucaugacagacggcucugcgagcggggucgccgauacccggauucucuucauccgcgagggaaagauuguucacguguccccucugagcggcucugcucagcauaucgaggaaugcuccuguuaucccagauacccugacgugcggugcgucugucgcgauaacuggaaagggagcaauagacccgugguugacaucaacauggccgauuauucuauugacagccacuacgugugcuccggacuugucggcgacaccccgcggaaugaugacucuagcuccagcucuaacuguaaggauccuaauaacgagcgcggcaaucccggggugaaaggaugggcuuuugacgauggcaacgacguuuggauggggagaacaaucucccgggauagcagaucuggauacgaaacguuccgcgugauuggcggguggaccacagccaauuccaagagccagaucaaccggcaggucauuguggacaauaacaauugguccggauauucuggcgucuuuagcguggagggcaaguccugcaucaacagauguuucuacguugaacugauucgcgggcggccucaagagaccagagugugguggacaucuaauagcaucgucguguuuugcggaaccuccggcacguaugggacaggaagcuggcccgauggcgcgaacaucaacuucaugcccauuuga

SEQ ID NO: 207469 - RNA, 1410 nt, Artificial Sequence
  derived and/or modified sequence opt5 from neuraminidase__InfluenzaA__AHJ58052
augaaccccaaucagaagaucauuaccaucggcagcgugucccugacaauugccacggucucuuuccucaugcaaaucgcuauucugaccacaaccguuacacuucacuuuaaacauaacgagugcaauaugccuccgaagaaccaggugaugagcugugaacccaucaucauugagagaaauaucaccgaaauuguguaccugaacaauacaaccgucgagaaagaaaucugcccuaaggugguugaguaucggaacugguccaaaccccaguguaagauuacgggguucgccccuuuuucuaaggacaauagcauccgccucuccgcgggaggcgauauuugggugaccagagagcccuacgucucuugcgggcugggaaaauguuaucaguucgcucuuggccaagggacaacccuggacaacagccacuccaauggaacaauccaugaucggaucccucaccgcacccuccugaugaacgaacugggcgugccguuucaucucggcacgaagcagguuugcauugccuggucuagcuccagcugucacgacgggagagccuggcugcacaucugcauuacaggagaugaccggaaugcuaccgccucuuucaucuacgauggcaugcuuguggacuccauugggagcuggucuaaaaacauccugcgcacacaggaguccgaaugugucugcaucaauggaaccugugcuguggugaugaccgauggcagcgccuccggggucgcggacacacggauucucuuuaucagagagggaaagauuguucauaucucuccccugagcggcuccgcccagcacauugaggaaugcagcugcuauccucgcuaccccgaugugagaugugugugccgggacaacuggaaaggcucuaaccgcccugucaucgauaucaauauggcugacuauuccauugacagcaacuacguguguucugggcuuguuggagauacgcccagaaaugacgauaacagcuccucuagcaauugccgggacccgaacaaugagcgcggcaacccuggggugaagggaugggccuucgaugacggcaaugaugucuggauggggagaaccaucaaccgggacuccagaagcggauacgaaacauuucgcgugauuggcggcuggaccacagcuaauucuaagucccaaaucaaccggcagguuauuguggauaauaacaauuggagcggguauucuggagucuucuccguggagggcaaaagcuguaucaacagaugcuuuuacgucgaacugauucgcgggcggccccaggagccuagagugugguggaccuccaacucuaucguuguguucuguggaacgagcggcacauaugggaccggcuccuggcccgacggagccaauaucaacuuuaugcccauuuga

SEQ ID NO: 207470 - RNA, 1413 nt, Artificial Sequence
  derived and/or modified sequence opt5 from neuraminidase__InfluenzaA__AHJ58064
augaaccccaaucagaagauuaccugcaucagcgccacaggcaugacgcuguccguggucucucuccugaucgggauugcuaaccuuggacugaauaucggccuccacuacaaaguuagcgacuccaccaacauuaauaucccuaacaugaaugagacaucuccgaccacaaccaucauuaacaaucauccccaaaacaauuucacaaacaucaccaauauuaucgugaacaagaaugaagaggaaaacuuucugaaccuuacgaaaccucugugugaggugaauagcuggcacauucucuccaaggauaacgccaucagaauuggggaaaaugcgcauauccuggucacccgggagcccuaucugucuugcgacccucagggaugucgcauguucgcucucagccagggcacaacccugagagggcagcacgccaacggaacaauccaugaucggucccccuuucgcgcccuuauuagcugggagaugggccaagcuccuucuccguacaaugccagaguggaaugcaucggcugguccagcaccucuugucacgacgggauuucccggaugagcaucugcauuucuggacccaacaauaacgcuuccgccguugugugguauggcgggcgcccugucacggagauccccagcugggcgggaaauauccugagaacacaggaauccgagugugugugccacggcgggauuuguccuguugugaugaccgauggacccgccaacaaucgggcugagacaaaaaucauuuacuucaaggaaggcaagauccagaaaauugaggaacucaagggcaacgcccagcauaucgaggaaugcucuuguuauggggcuagcggaaugaucaaaugcauuugccgcgacaauuggaagggcgccaacagaccggucaucaccauugauccugagaugaugacccacacauccaaauaccuguguagcaagauccuuacggacaccucucggcccaaugauccuauuaacgggaacugcgacgcgcccaucacaggaggcucccccgauccuggggugaagggauuugccuuccuggacggcgagaauagcuggcucggccgcaccauuucuaaagauagcagauccggguaugaaaugcugaaggugccgaacgcugagacagacacccaaucuggagccaucagccaucagaugaucgucaauaaccagaauugguccggcuacagcggggcuuuuauugacuacugggccaacaaagaauguuucaaucccugcuuuuauguugagcugauccggggacgcccuaaggaaucuuccgugcucuggacgagcaacucuauuguggcccuguguggcuccagagagcggcuugggagcugguccuggcacgauggcgcugagaucauuuacuucaaauga

SEQ ID NO: 207471 - RNA, 1401 nt, Artificial Sequence
  derived and/or modified sequence opt5 from neuraminidase__InfluenzaA__AHJ58075
augaaccccaaucagaagaucauugccaucggcagcgugucccugaccauugcuaucauuugcuuccuccugcaaaucgccauccuuacaacgaccaugacacugcacuuuagacagaacgaguguucuaauccuagcaacaaucaggucguuccgugcgaacccauuaucauugagcggaacaccgugcaucucaauuccacaaccaucgaaaaagagauuuguccuaagguggcggaauacaaaaacuggucuaagccccagugccaaaucacaggguucgcuccuuuuagcaaagacaauuccauucgccugucugccggaggcgauaucugggucaccagagagcccuaugugagcuguucccuugggaagugcuaccaguucgcccugggacagggcacgacccucaagaacaaacacagcaaugggacaacccaugaccggaucccucaccgcacacugcugaugaacgagcucggaguuccguuucaucugggcaccaaacagguguguauugcuuggucuuccagcucuugccacgauggcaaggccuggcuucacaucugugucacgggggacgauaagaaugcuacagccuccauuaucuaugacggaaugcugguggauagcauuggcucuugguccaaaaacauccucagaacccaagaaagcgagugcguuuguaucaaugggacaugcgcgguggucaugaccgacggauccgccucuggcaaggcugauacccggauucuguucauccgcgaagggaagauuaucaacauuagcccccuuuccggaagcgcccagcauguggaggagugcucuuguuacccuagauaucccgaagugcggugcgucugucgcgacaacuggaaaggcuccaauagaccuguucuguacaucaacauggcugauuauagcaucgagucuagcuacgugugcuccggccucgugggggacacaccccgggaugacgacucuagcuccagcucuaauugucgcgauccgaacaaugaaagaggagccccuggcgucaaggggugggcguuugacgauggaaacgacauuuggaugggccggacgaucaaauccgauagccgcucuggguacgagaccuucagagugguuaauggauggacaaccgccaacuccaagagccagauuaauagacaggugaucgucgacuccgauucuuggagcggcuauuccggcaucuuuucuguggaagggaaaaacugcauuaaucgguguuucuacguugagcugauucgcggacggccccaagagacaagagugugguggaccagcaacuccaucaucgucuuuugcggcacgagcgggacauauggaaccggcucuuggccugacggggcuaauauuaacuucaugcccaucuga

SEQ ID NO: 207472 - RNA, 1413 nt, Artificial Sequence
  derived and/or modified sequence opt5 from neuraminidase__InfluenzaA__AHJ58087
augaaccccaaucagaagauuaccugcaucagcgccacaggcaugacgcuguccguggucucucuccugaucgggauugcuaaccuuggacugaauaucggccuccacuacaaaguuagcgacuccaccaacauuaauaucccuaacaugaaugagacaucuccgaccacaaccaucauuaacaaucauccccaaaacaauuucacaaacaucaccaauauuaucgugaacaagaaugaagaggaaaacuuucugaaccuuacgaaaccucugugugaggugaauagcuggcacauucucuccaaggauaacgccaucagaauuggggaaaaugcgcauauccuggucacccgggagcccuaucugucuugcgacccucagggaugucgcauguucgcucucagccagggcacaacccugagagggcagcacgccaacggaacaauccaugaucggucccccuuucgcgcccuuauuagcugggagaugggccaagcuccuucuccguacaaugccagaguggaaugcaucggcugguccagcaccucuugucacgacgggauuucccggaugagcaucugcauuucuggacccaacaauaacgcuuccgccguugugugguauggcgggcgcccugucacggagauccccagcugggcgggaaauauccugagaacacaggaauccgagugugugugccacggcgggauuuguccuguugugaugaccgauggacccgccaacaaucgggcugagacaaaaaucauuuacuucaaggaaggcaagauccagaaaauugaggaacucaagggcaacgcccagcauaucgaggaaugcucuuguuauggggcuagcggaaugaucaaaugcauuugccgcgacaauuggaagggcgccaacagaccggucaucaccauugauccugagaugaugacccacacauccaaauaccuguguagcaagauccuuacggacaccucucggcccaaugauccuauuaacgggaacugcgacgcgcccaucacaggaggcucccccgauccuggggugaagggauuugccuuccuggacggcgauaauagcuggcucggccgcaccauuucuaaagacagcagauccggguaugagaugcugaaggugccgaacgcugaaacagacacccaaucuggagccaucagccaucagaugaucgucaauaaccagaauugguccggcuacagcggggcuuuuauugauuacugggccaacaaagaguguuucaaucccugcuuuuauguugaacugauccggggacgcccuaaggagucuuccgugcucuggacgagcaacucuauuguggcccuguguggcuccagagaacggcuugggagcugguccuggcacgacggcgcugagaucauuuacuucaaauga

SEQ ID NO: 207473 - RNA, 1410 nt, Artificial Sequence
  derived and/or modified sequence opt5 from neuraminidase__InfluenzaA__AHL80721
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaagggcuucgagaugauuugggauccuaauggguggaccggaaccgacaacaauuuuagcaucaaacaagacguggucggcaucaacgaaugguccggguacucuggcagcuucgugcagcaucccgagcuuacaggacuggauuguauucgcccuugcuucuggguugaacucaucagaggccggcccaaggagaauacgauuuggaccuccgggagcucuaucuccuuuuguggagugaacagcgacacagucggcuggucuuggcccgauggggcugagcugccuuucaccauugacaaauga

SEQ ID NO: 207474 - RNA, 1410 nt, Artificial Sequence
  derived and/or modified sequence opt5 from neuraminidase__InfluenzaA__AHL80732
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaucaucgacaaguga

SEQ ID NO: 207475 - RNA, 1410 nt, Artificial Sequence; identical to SEQ ID NO: 199762
  derived and/or modified sequence opt5 from neuraminidase__InfluenzaA__AHL80743

SEQ ID NO: 207476 - RNA, 1410 nt, Artificial Sequence
  derived and/or modified sequence opt5 from neuraminidase__InfluenzaA__AHL80754
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugugugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggccgagcugccuuucaccaucgacaaguga

SEQ ID NO: 207477 - RNA, 1410 nt, Artificial Sequence; identical to SEQ ID NO: 199762
  derived and/or modified sequence opt5 from neuraminidase__InfluenzaA__AHL80765

SEQ ID NO: 207478 - RNA, 1410 nt, Artificial Sequence; identical to SEQ ID NO: 199762
  derived and/or modified sequence opt5 from neuraminidase__InfluenzaA__AHL80776

SEQ ID NO: 207479 - RNA, 1410 nt, Artificial Sequence; identical to SEQ ID NO: 199762
  derived and/or modified sequence opt5 from neuraminidase__InfluenzaA__AHL80787

SEQ ID NO: 207480 - RNA, 1410 nt, Artificial Sequence
  derived and/or modified sequence opt5 from neuraminidase__InfluenzaA__AHL80798
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaagggauccugcggcccggucagcucuaauggggccaacggagugaagggcuucuccuuuaaauauggcaacgggguuuggauuggaagaaccaagagcaucuccucucggaauggcuucgagaugauuugggauccuaacggguggacaggaaccgacaauaacuuuagcgugaaacaagacaucgucggcaucaaugaaugguccggguacucuggcagcuucgugcagcaucccgagcuuaccggacuggauuguauucgcccuugcuucuggguugaacucaucagaggccggcccaaggagaacacaauuuggacguccgggagcucuaucuccuuuuguggagugaauagcgacaccgucggcuggucuuggcccgauggggcugagcugccuuucacaauugacaaauga

SEQ ID NO: 207481 - RNA, 1410 nt, Artificial Sequence; identical to SEQ ID NO: 199762
  derived and/or modified sequence opt5 from neuraminidase__InfluenzaA__AHL80809

SEQ ID NO: 207482 - RNA, 1410 nt, Artificial Sequence; identical to SEQ ID NO: 199762
  derived and/or modified sequence opt5 from neuraminidase__InfluenzaA__AHL80820

SEQ ID NO: 207483 - RNA, 1410 nt, Artificial Sequence; identical to SEQ ID NO: 199762
  derived and/or modified sequence opt5 from neuraminidase__InfluenzaA__AHL80831

SEQ ID NO: 207484 - RNA, 1410 nt, Artificial Sequence; identical to SEQ ID NO: 199762
  derived and/or modified sequence opt5 from neuraminidase__InfluenzaA__AHL80842

SEQ ID NO: 207485 - RNA, 1410 nt, Artificial Sequence; identical to SEQ ID NO: 201050
  derived and/or modified sequence opt5 from neuraminidase__InfluenzaA__AHL80853

SEQ ID NO: 207486 - RNA, 1410 nt, Artificial Sequence
  derived and/or modified sequence opt5 from neuraminidase__InfluenzaA__AHL80864
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaagggauccugcggcccggucagcucuaauggggccaacggagugaagggcuucuccuuuaaauacggcaacgggguuuggauuggaagaaccaagagcaucuccucucggaauggcuucgagaugauuugggauccuaacggguggacaggaaccgacaauaacuuuagcaucaaacaagacaucgugggcauuaaugaaugguccggguauucuggcagcuucguccagcaccccgagcuuaccggacuggauuguauccgcccuugcuucuggguggaacucauuagaggccggcccaaggagaacacaaucuggacguccgggagcucuauuuccuuuuguggaguuaauagcgacaccgugggcuggucuuggcccgauggggcugagcugccuuucacaaucgacaaauga

SEQ ID NO: 207487 - RNA, 1410 nt, Artificial Sequence; identical to SEQ ID NO: 201050
  derived and/or modified sequence opt5 from neuraminidase__InfluenzaA__AHL80875

SEQ ID NO: 207488 - RNA, 1410 nt, Artificial Sequence; identical to SEQ ID NO: 201050
  derived and/or modified sequence opt5 from neuraminidase__InfluenzaA__AHL80886

SEQ ID NO: 207489 - RNA, 1410 nt, Artificial Sequence
  derived and/or modified sequence opt5 from neuraminidase__InfluenzaA__AHL80897
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcauuaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaagggauccugcggcccggugagcucuaauggggccaacggagucaagggcuucuccuuuaaauauggcaacgggguguggaucggaagaaccaagagcauuuccucucggaauggcuucgagaugaucugggauccuaacggguggacaggaaccgacaauaacuuuagcaucaaacaagacauuguuggcaucaaugaaugguccggguacucuggcagcuucgugcagcaucccgagcuuaccggacuggauuguauucgcccuugcuucugggucgaacucaucagaggccggcccaaggagaacacaauuuggacguccgggagcucuaucuccuuuuguggagugaauagcgacaccguuggcuggucuuggcccgauggggcugagcugccuuucacaaucgacaaauga

SEQ ID NO: 207490 - RNA, 1410 nt, Artificial Sequence
  derived and/or modified sequence opt5 from neuraminidase__InfluenzaA__AHL80908
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucaccauucaugaaaauaacacauggguuaaucagaccuacgugaacaucucuaauacaaacuucgcugccgggcagagcguggucuccgugaaacuugcgggaaauucuagccugugcccuguuuccggcugggcuauuuauagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaccggacgcucaugucuugucccaucggggaggugccuucccccuauaacagccgcuuugaauccguugccuggucugcuagcgccugccaugacggaauuaauuggcugaccaucggcaucuccgggccugauaacggagcuguggccguccugaaguacaauggcauuaucacagacaccauuaagagcuggagaaacaauauccuccggacacaagagucugagugugcgugcgugaacggguccuguuucaccgugaugacggauggaccgagcgacggccaggccucuuauaaaauuuuucgcaucgaaaagggcaaaaucgucaagagcguugagaugaaugcucccaacuacuauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaagggauccugcggcccggucagcucuaauggggccaacggagugaagggcuucuccuuuaaauauggcaacgggguuuggauuggaagaaccaagagcaucuccucucggaauggcuucgagaugauuugggauccuaacggguggacaggaaccgacaauaacuuuagcaucaaacaagacaucgugggcauuaaugaaugguccggguacucuggcagcuucguccagcaucccgagcuuaccggacuggauuguauccgcccuugcuucuggguggaacucauuagaggccggcccaaggagaacacaaucuggacguccgggagcucuauuuccuuuuguggaguuaauagcgacaccgugggcuggucuuggcccgauggggcugagcugccuuucacaaucgacaaauga

SEQ ID NO: 207491 - RNA, 1410 nt, Artificial Sequence
  derived and/or modified sequence opt5 from neuraminidase__InfluenzaA__AHL80919
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaccggggaggugccuagccccuacaacucccgcuuugaaucuguugccuggagcgcuuccgccugccacgacggaaucaacuggcugacaauuggcaucagcgggccugauaauggagcuguggccguccugaaguauaacggcaucauuaccgacacaaucaagucuuggagaaauaacauucuccggacccaagaguccgagugugcgugcgugaaugggagcuguuucacgaucaugacagauggaccgucugacggccaggccagcuacaaaauuuuucgcaucgaaaagggcaaaaucgugaaguccgucgagaugaacgcucccaauuaucauuacgaagagugcucuuguuacccugauagcuccgagauuaccugcguuugcagagacaacuggcacgggagcaaucggcccugggugucuuucaaccagaaucuggaauaucagaucggauacauuuguuccggcaucuuuggggauaacccucgccccaaugacaaaacaggaagcugcggcccggugucuuccaacggggccaauggagucaagggcuucagcuuuaaguauggcaacgggguguggauuggaagaaccaaauccaucucuagccggaagggcuucgagaugauuugggauccuaacggguggaccggaacagacaauaacuuuuccaucaaacaagacaucguuggcauuaaugaauggucuggguacagcggcuccuucgugcagcaucccgagcuuacgggacuggauuguauccgcccuugcuucugggucgaacucauuagaggccggcccaaggagaacaccaucuggacaagcgggucuuccauuagcuuuuguggaguuaauucugacaccgugggcugguccuggcccgauggggcugagcugccuuucacaaucgacaaauga

SEQ ID NO: 207492 - RNA, 1410 nt, Artificial Sequence; identical to SEQ ID NO: 202542
  derived and/or modified sequence opt5 from neuraminidase__InfluenzaA__AHL80930

SEQ ID NO: 207493 - RNA, 1410 nt, Artificial Sequence; identical to SEQ ID NO: 202542
  derived and/or modified sequence opt5 from neuraminidase__InfluenzaA__AHL80949

SEQ ID NO: 207494 - RNA, 1410 nt, Artificial Sequence
  derived and/or modified sequence opt5 from neuraminidase__InfluenzaA__AHL80961
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacaauuuuagcaucaaacaagacguugugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 207495 - RNA, 1410 nt, Artificial Sequence; identical to SEQ ID NO: 207494
  derived and/or modified sequence opt5 from neuraminidase__InfluenzaA__AHL80972

SEQ ID NO: 207496 - RNA, 1410 nt, Artificial Sequence; identical to SEQ ID NO: 202542
  derived and/or modified sequence opt5 from neuraminidase__InfluenzaA__AHL80983

SEQ ID NO: 207497 - RNA, 1410 nt, Artificial Sequence; identical to SEQ ID NO: 202542
  derived and/or modified sequence opt5 from neuraminidase__InfluenzaA__AHL80992

SEQ ID NO: 207498 - RNA, 1410 nt, Artificial Sequence; identical to SEQ ID NO: 202542
  derived and/or modified sequence opt5 from neuraminidase__InfluenzaA__AHL81004

SEQ ID NO: 207499 - RNA, 1410 nt, Artificial Sequence
  derived and/or modified sequence opt5 from neuraminidase__InfluenzaA__AHL81016
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauagcgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggccggcuuguugauuccguggucagcuggucuaaagagauccugcgcacccaggaauccgagugugugugcauuaacgggacauguacgguggucaugaccgacggaagcgcuuccggcaaggccgauacaaaaauccucuuuaucgaggaagggaagauuguucauaccucuacacugagcggauccgcgcaacacguggaggaaugcagcugcuaucccagauacccuggcgugcggugugucugccgcgacaacuggaaggggucuaauagacccaucguggauauuaacaucaaagaccacuccauuguuagcucuuacguguguagcggacuugucggcgacaccccucggaagaaugauuccucuagcuccagccauugccuggaccccaacaaugaggaaggcgggcacggagugaaaggcugggccuucgaugacgggaacgauguuuggaugggacgcacgaucaaugagacaucuagacucggcuaugagaccuuuaaggugaucgaagggugguccaacccgaaaagcaagcugcagauuaaucggcaggucaucguggaccgcggaaacagaucuggcuacuccggcauuuucagcgucgaggggaaauccuguaucaaucggugcuuuuauguggaacugauuagaggacgcaaggaggaaaccgagguucucuggacaucuaacagcaucguggucuucuguggcaccuccgggacauacggaacgggcucuuggccugauggggcugaccugaaucuuaugcccauuuga

SEQ ID NO: 207500 - RNA, 1410 nt, Artificial Sequence; identical to SEQ ID NO: 202542
  derived and/or modified sequence opt5 from neuraminidase__InfluenzaA__AHL81028

SEQ ID NO: 207501 - RNA, 1410 nt, Artificial Sequence; identical to SEQ ID NO: 202542
  derived and/or modified sequence opt5 from neuraminidase__InfluenzaA__AHL81040

SEQ ID NO: 207502 - RNA, 1410 nt, Artificial Sequence; identical to SEQ ID NO: 202542
  derived and/or modified sequence opt5 from neuraminidase__InfluenzaA__AHL81052

SEQ ID NO: 207503 - RNA, 1410 nt, Artificial Sequence; identical to SEQ ID NO: 207494
  derived and/or modified sequence opt5 from neuraminidase__InfluenzaA__AHL81064

SEQ ID NO: 207504 - RNA, 1410 nt, Artificial Sequence; identical to SEQ ID NO: 207494
  derived and/or modified sequence opt5 from neuraminidase__InfluenzaA__AHL81075

SEQ ID NO: 207505 - RNA, 1410 nt, Artificial Sequence
  derived and/or modified sequence opt5 from neuraminidase__InfluenzaA__AHL81086
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuguaagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccagcagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugaaacaagcagacucggcuaugagaccuuuaaagugaucgagggguggucuaacccuaaguccaaacugcagauuaaucggcaggucaucguggaccgcggaaacagaagcggcuacucuggcauuuucuccgucgaagggaagucuuguaucaaucggugcuuuuauguggagcugauuagaggacgcaaggaagagaccgaaguucucuggacauccaacucuaucguggucuucuguggcaccagcgggacauacggaacgggcuccuggcccgauggggcugaccugaaucuuaugccuauuuga

SEQ ID NO: 207506 - RNA, 1410 nt, Artificial Sequence
  derived and/or modified sequence opt5 from neuraminidase__InfluenzaA__AHL81098
augaaccccaaucagaagaucauuaccaucggcagcgugucccugacaauuucuacgaucugcuucuuuguccaaauugccauccucaucaccacaguuacccugcacuucaaacaguacgaguuuaacagcccuccgaauaaccaggugaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcauugccugguccucuagcuccugucaugacggaaaggccuggcugcacguuugcaucacaggcgaugacaagaacgcuaccgccagcuucauuuacaauggccggcuuguggauucugucguguccuggagcaaagagauccugcgcacccaggaaucugagugugugugcauuaacgggacauguacggucguuaugaccgacggauccgcuagcggcaaggccgauacaaaaauccucuuuaucgaggaagggaagauugugcauaccuccacacugucuggaagcgcgcaacacguggaggaaugcuccugcuauccuagauaccccggcguccggugugugugccgcgacaacuggaaggggagcaauagaccuaucguugauauuaacaucaaagaccacucuauuguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccaucaaugagacaagcagacucggcuaugagaccuuuaaggucaucgaaggguggucuaacccuaaauccaagcugcagauuaaucgccaggugaucgucgaccggggaaacagaagcggcuacucuggcauuuucuccguggaggggaaaagcuguaucaaucggugcuuuuauguugaacugauuagaggacgcaaggaggaaaccgaggugcucuggacauccaacucuaucgucguguucuguggcaccagcgggacauacggaacgggcuccuggcccgauggggcugaccugaaucuuaugccuauuuga

SEQ ID NO: 207507 - RNA, 1410 nt, Artificial Sequence; identical to SEQ ID NO: 203733
  derived and/or modified sequence opt5 from neuraminidase__InfluenzaA__AHL81110

SEQ ID NO: 207508 - RNA, 1410 nt, Artificial Sequence; identical to SEQ ID NO: 203733
  derived and/or modified sequence opt5 from neuraminidase__InfluenzaA__AHL81121

SEQ ID NO: 207509 - RNA, 1410 nt, Artificial Sequence; identical to SEQ ID NO: 202542
  derived and/or modified sequence opt5 from neuraminidase__InfluenzaA__AHL81132

SEQ ID NO: 207510 - RNA, 1410 nt, Artificial Sequence; identical to SEQ ID NO: 202542
  derived and/or modified sequence opt5 from neuraminidase__InfluenzaA__AHL81144

SEQ ID NO: 207511 - RNA, 1410 nt, Artificial Sequence; identical to SEQ ID NO: 202542
  derived and/or modified sequence opt5 from neuraminidase__InfluenzaA__AHL81156

SEQ ID NO: 207512 - RNA, 1410 nt, Artificial Sequence; identical to SEQ ID NO: 204811
  derived and/or modified sequence opt5 from neuraminidase__InfluenzaA__AHL81168

SEQ ID NO: 207513 - RNA, 1410 nt, Artificial Sequence; identical to SEQ ID NO: 204811
  derived and/or modified sequence opt5 from neuraminidase__InfluenzaA__AHL81180

SEQ ID NO: 207514 - RNA, 1410 nt, Artificial Sequence; identical to SEQ ID NO: 202542
  derived and/or modified sequence opt5 from neuraminidase__InfluenzaA__AHL81192

SEQ ID NO: 207515 - RNA, 1410 nt, Artificial Sequence
  derived and/or modified sequence opt5 from neuraminidase__InfluenzaA__AHL81215
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucauguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugugucuugcgauccugacaaguguuaccaauucgcucuugggcagggaaccacacugaauaacguccauagcaauaacaccgugcgggaucgcacgccguauagaacacuccugaugaaugaacugggcguucccuuucaccucgggaccaaacaggugugcauugccugguccucuagcuccugucaugacggaaaggccuggcugcacgucugcaucacaggcgaugacaagaacgcuaccgccagcuucauuuacaauggccggcuuguggauucuguuguguccuggagcaaagagauccugcgcacccaggaaucugagugugucugcauuaacgggacauguacgguggugaugaccgacggauccgcuagcggcaaggccgauacaaaaauccucuuuaucgaggaagggaagauuguccauaccuccacacugucuggaagcgcgcaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucaaugagacaagcagacucggcuaugagaccuuuaagguuaucgaaggguggucuaacccuaaauccaagcugcagauuaaucgccaggugaucgucgaccggggaaacagaagcggcuacucuggcauuuucuccguggaggggaaaagcuguaucaaucggugcuuuuaugucgaacugauuagaggacgcaaggaggaaaccgaggugcucuggacauccaacucuaucguuguguucuguggcaccagcgggacauacggaacgggcuccuggcccgauggggcugaccugaauuucaugccuauuuga

SEQ ID NO: 207516 - RNA, 1410 nt, Artificial Sequence
  derived and/or modified sequence opt5 from neuraminidase__InfluenzaA__AHL81227
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaccggggaggugccuagccccuacaacucccgcuuugaaucuguugccuggagcgcuuccgccugccacgacggaaucaacuggcugacaauuggcaucagcgggccugauaauggagcuguggccguccugaaguauaacggcaucauuaccgacacaaucaagucuuggagaaauaacauucuccggacccaagaguccgagugugcgugcgugaaugggagcuguuucacgaucaugacagauggaccgucugacggccaggccagcuacaaaauuuuucgcaucgaaaagggcaaaaucgugaaguccgucgagaugaacgcucccaauuaucauuacgaagagugcucuuguuacccugauagcuccgagauuaccugcguuugcagagacaacuggcacgggagcaaucggcccugggugucuuucaaccagaaucuggaauaucagaucggauacauuuguuccggcaucuuuggggauaacccucgccccaaugacaaaacaggaagcugcggcccggugucuuccaacggggccaauggagucaagggcuucagcuuuaaguauggcaacgggguguggauuggaagaaccaaauccaucucuagccggaagggcuucgagaugauuugggauccuaacggguggaccggaacagacaauaacuuuuccaucaaacaagacaucauuggcaucaaugaauggucuggguacagcggcuccuucguucagcaucccgagcuuacgggacuggauuguauucgcccuugcuucuggguggaacucaucagaggccggcccaaggagaacaccauuuggacaagcgggucuuccaucagcuuuuguggagucaauucugacaccgugggcugguccuggcccgauggggcugagcugccuuucacaaucgacaaauga

SEQ ID NO: 207517 - RNA, 1410 nt, Artificial Sequence; identical to SEQ ID NO: 202542
  derived and/or modified sequence opt5 from neuraminidase__InfluenzaA__AHL81238

SEQ ID NO: 207518 - RNA, 1410 nt, Artificial Sequence; identical to SEQ ID NO: 202542
  derived and/or modified sequence opt5 from neuraminidase__InfluenzaA__AHL81250

SEQ ID NO: 207519 - RNA, 1410 nt, Artificial Sequence; identical to SEQ ID NO: 202542
  derived and/or modified sequence opt5 from neuraminidase__InfluenzaA__AHL81262

SEQ ID NO: 207520 - RNA, 1410 nt, Artificial Sequence; identical to SEQ ID NO: 202542
  derived and/or modified sequence opt5 from neuraminidase__InfluenzaA__AHL81274

SEQ ID NO: 207521 - RNA, 1410 nt, Artificial Sequence; identical to SEQ ID NO: 202542
  derived and/or modified sequence opt5 from neuraminidase__InfluenzaA__AHL81286

SEQ ID NO: 207522 - RNA, 1410 nt, Artificial Sequence; identical to SEQ ID NO: 202542
  derived and/or modified sequence opt5 from neuraminidase__InfluenzaA__AHL81298

SEQ ID NO: 207523 - RNA, 1410 nt, Artificial Sequence; identical to SEQ ID NO: 207494
  derived and/or modified sequence opt5 from neuraminidase__InfluenzaA__AHL81310

SEQ ID NO: 207524 - RNA, 1410 nt, Artificial Sequence; identical to SEQ ID NO: 203733
  derived and/or modified sequence opt5 from neuraminidase__InfluenzaA__AHL81332

SEQ ID NO: 207525 - RNA, 1410 nt, Artificial Sequence
  derived and/or modified sequence opt5 from neuraminidase__InfluenzaA__AHL81343
augaaccccaaucagaagaucauuaccaucggcagcgugucccugacaauuucuacgaucugcuuccucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguuugccccuuucucuaaagauaacagcauccgccuuuccgcgggaggcgacaucugggugacaagagagcccuaugucucuugcgauccugacaaguguuaccaauuugcucuggggcagggaaccacacucaauaacgugcauagcaauaacaccguucgggaucgcacgccguauagaacacugcugaugaaugaacucggcgugcccuuccaccuggggaccaagcaggucugcauugccugguccucuagcuccugucaugacggaaaagccuggcuucacgugugcaucacaggcgaugacaagaacgcuaccgccagcuuuauuuacaauggccggcugguugauucuguggucuccuggagcaaagagauccuccgcacccaggaaucugagugugugugcauuaacgggacauguacgguggucaucaccgacggauccgcuagcggcaaggccgauacaaaaauccuguucauugaggaagggaagaucguucauaccuccacacuuucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuggucggcgacacgccccggaagaaugauagcuccucuagcucccauugcagcgacccgaacaaugaggaaggcgggcacggagugaaaggcugggccuuugaugacgggaacgauguuuggaugggacgcaccaucucugagaaguccagacucggcuaugagacauucaaagugauugaaggguggagcaauccuaagucuaaacugcagaucaaccggcaggucauuguggaccgcggaaauagauccggcuacagcggcaucuuuuccgucgaggggaagucuuguauuaaccggugcuucuauguggaacugaucagaggacgcaaggaggaaaccgagguucucuggaccagcaauuccauuguggucuuuuguggcacaucugggaccuacggaacaggcagcuggcccgauggggcugacaucaaccugaugccuaucuga

SEQ ID NO: 207526 - RNA, 1410 nt, Artificial Sequence; identical to SEQ ID NO: 202542
  derived and/or modified sequence opt5 from neuraminidase__InfluenzaA__AHL81355

SEQ ID NO: 207527 - RNA, 1410 nt, Artificial Sequence; identical to SEQ ID NO: 203733
  derived and/or modified sequence opt5 from neuraminidase__InfluenzaA__AHL81367

SEQ ID NO: 207528 - RNA, 1410 nt, Artificial Sequence; identical to SEQ ID NO: 203733
  derived and/or modified sequence opt5 from neuraminidase__InfluenzaA__AHL81378

SEQ ID NO: 207529 - RNA, 1410 nt, Artificial Sequence; identical to SEQ ID NO: 203733
  derived and/or modified sequence opt5 from neuraminidase__InfluenzaA__AHL81389

SEQ ID NO: 207530 - RNA, 1410 nt, Artificial Sequence; identical to SEQ ID NO: 202542
  derived and/or modified sequence opt5 from neuraminidase__InfluenzaA__AHL81400

SEQ ID NO: 207531 - RNA, 1410 nt, Artificial Sequence; identical to SEQ ID NO: 207515
  derived and/or modified sequence opt5 from neuraminidase__InfluenzaA__AHL81412

SEQ ID NO: 207532 - RNA, 1410 nt, Artificial Sequence; identical to SEQ ID NO: 199762
  derived and/or modified sequence opt5 from neuraminidase__InfluenzaA__AHL81422

SEQ ID NO: 207533 - RNA, 1410 nt, Artificial Sequence; identical to SEQ ID NO: 201050
  derived and/or modified sequence opt5 from neuraminidase__InfluenzaA__AHL81433

SEQ ID NO: 207534 - RNA, 1410 nt, Artificial Sequence
  derived and/or modified sequence opt5 from neuraminidase__InfluenzaA__AHL88954
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucaaggaggggaagauuguucacaccuccacacugucuggaagcgcgcaacacguggaagagugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucagcgaaaaacuccgcucuggcuacgagacauuuaaggugaucgaggggugguccaauccuaacagcaaacugcagauuaauagacaggucaucguggaccgggauaaccgcucuggauauuccggcauuuucagcgucgaaggcaaguccuguaucaauagaugcuuuuacguggagcugauucgggggagaaaggaagagaccgaaguucucuggaccucuaacagcaucguggucuucuguggaacauccggcaccuaugggacaggaucuuggcccgacggcgcugauauuaaucugaugccuaucuga

SEQ ID NO: 207535 - RNA, 1410 nt, Artificial Sequence
  derived and/or modified sequence opt5 from neuraminidase__InfluenzaA__AHL89033
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggauaaauccuguaucaauagaugcuuuuacguggaacugauucgggggagaaaggaggaaaccgagguucucuggaccucuaacagcaucguggucuucuguggaacauccggcaccuaugggacaggaucuuggcccgacggcgcugauauuaaucugaugccuaucuga

SEQ ID NO: 207536 - RNA, 1410 nt, Artificial Sequence
  derived and/or modified sequence opt5 from neuraminidase__InfluenzaA__AHL89045
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgccaucccggcgugagaugugucugccgggacaacuggaaggggagcaaucgcccuaucguggauauuaacaucaaagacuacucuauuguuuccagcuacguguguucuggacuugucggcgacacccccagaaagaaugauagcuccucuagcucccacugccuggacccgaacaaugaggaaggcgggcauggagugaaaggcugggccuucgaugacgggaacgauguuuggaugggacggacgaucagcgagaagcuccgcucuggcuaugagacauuuaaagugaucgaagggugguccaauccuaacagcaagcugcagaccaauagacaggucauuguggaccggggaaaccgcucuggcuacuccggcaucuucagcgucgaggggaaauccuguauuaauagaugcuuuuauguggaacugauccggggaagaaaggaggaaaccgagguucucuggacaucuaacagcauuguggucuucuguggcaccuccgggacauacggaacgggcucuuggcccgauggggcugacaucaaucugaugccuauuuga

SEQ ID NO: 207537 - RNA, 1410 nt, Artificial Sequence
  derived and/or modified sequence opt5 from neuraminidase__InfluenzaA__AHL89057
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaagccuaauagcaaacugcagauuaacagacaggucaucguggaccggggaaaucgcucuggcuauuccggcauuuucagcgucgaggggaaguccuguaucaacagaugcuuuuacguggaacugauucggggaagaaaggaggaaaccgagguucucuggaccucuaauagcaucguggucuucuguggcacauccgggaccuauggaacaggcucuuggcccgauggggcugacauuaaccugaugccuaucuga

SEQ ID NO: 207538 - RNA, 1410 nt, Artificial Sequence; identical to SEQ ID NO: 198731
  derived and/or modified sequence opt5 from neuraminidase__InfluenzaA__AHL89069

SEQ ID NO: 207539 - RNA, 1410 nt, Artificial Sequence; identical to SEQ ID NO: 197736
  derived and/or modified sequence opt5 from neuraminidase__InfluenzaA__AHL89081

SEQ ID NO: 207540 - RNA, 1410 nt, Artificial Sequence; identical to SEQ ID NO: 197736
  derived and/or modified sequence opt5 from neuraminidase__InfluenzaA__AHL89093

SEQ ID NO: 207541 - RNA, 1410 nt, Artificial Sequence; identical to SEQ ID NO: 197736
  derived and/or modified sequence opt5 from neuraminidase__InfluenzaA__AHL89117

SEQ ID NO: 207542 - RNA, 1410 nt, Artificial Sequence; identical to SEQ ID NO: 197736
  derived and/or modified sequence opt5 from neuraminidase__InfluenzaA__AHL89129

SEQ ID NO: 207543 - RNA, 1410 nt, Artificial Sequence
  derived and/or modified sequence opt5 from neuraminidase__InfluenzaA__AHL89141
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgccugggcuacgagacauuuaaagugaucgaaggguggucuaauccuaacuccaagcugcagaccaauagacaggucauuguggaccggggaaaccgcagcggcuauucuggcaucuucuccgucgaggggaaaagcuguauuaauagaugcuuuuacguggaacucauccggggaagaaaggaggaaaccgagguucuguggacauccaacucuauuguggucuucuguggcaccagcgggacauauggaacgggcuccuggcccgauggggcugacaucaaucuuaugccuauuuga

SEQ ID NO: 207544 - RNA, 1410 nt, Artificial Sequence
  derived and/or modified sequence opt5 from neuraminidase__InfluenzaA__AHL89153
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucagccuugggcagggaaccacacugaacaaugugcauuccaacgacaccguucacgaucggacgccguaucgcacacuccugaugaaugaacugggcgugcccuuucaucucgggaccaagcaggucugcauugcuuggucuagcuccagcugucacgacggaaaagccuggcugcaugugugcguuacaggcgaugacaagaacgccaccgcuucuuucaucuacaauggcagacuuguggauuccauugucagcuggucuaaagagauccugcggacccaggaauccgagugugugugcauuaacgggacauguacgguggucaugaccgacggaagcgccuccggcaaggcugauacaaaaauccucuuuaucgaggaagggaagauuguucacaccucuacacugagcggauccgcccaacacguggaggaaugcagcugcuauccucgcuaccccggcgugagaugugucugccgggacaacuggaaggggucuaaucgcccuaucguggauauuaacaucaaagacuacuccauuguuagcucuuauguguguagcggacuugucggcgacacccccagaaagaaugauuccucuagcuccagccauugccuggacccgaacaaugaggaaggcgggcacggagugaaaggcugggcguucgaugacgggaacgauguuuggaugggacggacgaucucugagaagcuccgcuccggcuacgagacauuuaaagugaucgaaggguggagcaauccuaacucuaagcugcagauuaauagacaggucaucguggaccggggaaaccgcuccggcuauagcggcauuuucuccgucgaggggaaaucuuguaucaauagaugcuuuuacguggaacugauucggggaagaaaggaggaaaccgagguucucuggaccagcaacuccaucguggucuucuguggcacaucugggaccuauggaacaggcagcuggcccgauggggccgacauuaaucugaugccuaucuga

SEQ ID NO: 207545 - RNA, 1410 nt, Artificial Sequence; identical to SEQ ID NO: 197736
  derived and/or modified sequence opt5 from neuraminidase__InfluenzaA__AHL89165

SEQ ID NO: 207546 - RNA, 1410 nt, Artificial Sequence
  derived and/or modified sequence opt5 from neuraminidase__InfluenzaA__AHL89177
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaacgagauccugcggacccaggaaucugagugugugugcauuaacgggacauguacgguggucaugaccgacggauccgcuagcggcaaagccgauacaaagauccucuuuaucgaggaagggaaaauuguucacaccuccacacugucuggaagcgcgcaacacguggaggaaugcuccugcuauccucgcuaccccggcgugagaugugucugccgggacaauuggaaggggagcaaccgcccuaucguggauauuaauaucaaggacuacucuauuguuuccagcuauguguguucuggacuugucggcgacacccccagaaagaacgauagcuccucuagcucccauugccuggacccgaauaacgaggaaggcgggcacggagugaaaggcugggccuucgaugacgggaaugauguuuggaugggacggacgaucagcgagaaacuccgcucuggcuacgagacauuuaaggugaucgaagggugguccaacccuaauagcaaacugcagauuaacagacaggucaucguggaccggggaaaucgcucuggcuauuccggcauuuucagcgucgaggggaaguccuguaucaacagaugcuuuuacguggaacugauucggggaagaaaagaggaaaaugagguucucuggaccucuaacagcaucguggucuucuguggcaccuccgggacauauggaaccggcucuuggcccgauggggcugacauuaaucugaugccuaucuga

SEQ ID NO: 207547 - RNA, 1410 nt, Artificial Sequence; identical to SEQ ID NO: 199588
  derived and/or modified sequence opt5 from neuraminidase__InfluenzaA__AHL89189

SEQ ID NO: 207548 - RNA, 1410 nt, Artificial Sequence; identical to SEQ ID NO: 198731
  derived and/or modified sequence opt5 from neuraminidase__InfluenzaA__AHL89201

SEQ ID NO: 207549 - RNA, 1410 nt, Artificial Sequence; identical to SEQ ID NO: 199588
  derived and/or modified sequence opt5 from neuraminidase__InfluenzaA__AHL89213

SEQ ID NO: 207550 - RNA, 1410 nt, Artificial Sequence
  derived and/or modified sequence opt5 from neuraminidase__InfluenzaA__AHL89225
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucaguguaacauuaccggguucgcccccuuuuccaaagacaauucuauccgccugagcgcgggaggcgauaucugggugacaagagagccuuaugucuccugcgacccggauaaguguuaccaauucgcucuugggcagggaaccacacugaacaaugugcauucuaacgacaccguucacgaucggacgcccuaucgcacacuccugaugaaugaacugggcgugccuuuucaucucgggaccaagcaggucugcauugccuggagcuccagcucuugucacgacggaaaagccuggcugcaugugugcguuacaggcgaugacaagaacgcuaccgccuccuucaucuacaauggcagacuuguggauagcauugucucuugguccaaagagauccugcggacccaggaaagcgagugugugugcauuaacgggacauguacgguggucaugaccgacggaucugcuuccggcaaggccgauacaaaaauccucuuuaucgaggaagggaagauuguucacaccagcacacuguccggaucugcgcaacacguggaggaaugcagcugcuauccccgcuacccuggcgugagaugugucugccgggacaacuggaagggguccaaucgccccaucguggauauuaacaucaaagacuacagcauuguuucuuccuauguguguagcggacuugucggcgacaccccgagaaagaaugauucuagcuccucuagccauugccuggacccuaacaaugaggaaggcgggcacggagugaaaggcugggccuucgaugacgggaacgauguuuggaugggacggacgaucuccgagaagcuccgccugggcuacgagacauuuaaagugaucgaaggguggagcaaucccaacucuaagcugcagaccaauagacaggucauuguggaccggggaaaccgcuccggcuauagcggcaucuucucugucgaggggaaauccuguauuaauagaugcuuuuacguggaacucauccggggaagaaaggaggaaaccgagguucuguggacaagcaacuccauuguggucuucuguggcaccucugggacauauggaacgggcagcuggccugauggggcugacaucaaucuuaugcccauuuga

SEQ ID NO: 207551 - RNA, 1410 nt, Artificial Sequence; identical to SEQ ID NO: 199588
  derived and/or modified sequence opt5 from neuraminidase__InfluenzaA__AHL89237

SEQ ID NO: 207552 - RNA, 1410 nt, Artificial Sequence; identical to SEQ ID NO: 198731
  derived and/or modified sequence opt5 from neuraminidase__InfluenzaA__AHL89261

SEQ ID NO: 207553 - RNA, 1410 nt, Artificial Sequence
  derived and/or modified sequence opt5 from neuraminidase__InfluenzaA__AHL89273
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgccugggcuacgagacauuuaaagugaucgaaggguggucuaauccuaacuccaagcugcagaccaauagacaggucauuguggaccggggaaaccgcagcggcuauucuggcaucuucuccgucgaggggaaaagcuguauuaauagaugcuuuuacguggaacucauccggggaagaaaggaggaaaccgauguucuguggacauccaacucuauuguggucuucuguggcaccagcgggacauauggaacgggcuccuggcccgacggggcugauaucaaucuuaugccuauuuga

SEQ ID NO: 207554 - RNA, 1410 nt, Artificial Sequence
  derived and/or modified sequence opt5 from neuraminidase__InfluenzaA__AHL89285
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgccugggcuacgagacauuuaaagugaucgaaggguggucuaauccuaacuccaagcugcagaccaauagacaggucauuguggaccggggaaaccgcagcggcuauucuggcaucuucuccgucgaggggaaaagcuguauuaauagaugcuuuuacguggaacucauccggggaagaaaggaggaaaccgauguucuguggacauccaacucuauuguggucuucuguagcaccuccggcacauaugggacgggaucuuggcccgacggcgcugauaucaaucuuaugccuauuuga

SEQ ID NO: 207555 - RNA, 1410 nt, Artificial Sequence; identical to SEQ ID NO: 207553
  derived and/or modified sequence opt5 from neuraminidase__InfluenzaA__AHL89297

SEQ ID NO: 207556 - RNA, 1410 nt, Artificial Sequence; identical to SEQ ID NO: 207553
  derived and/or modified sequence opt5 from neuraminidase__InfluenzaA__AHL89309

SEQ ID NO: 207557 - RNA, 1410 nt, Artificial Sequence
  derived and/or modified sequence opt5 from neuraminidase__InfluenzaA__AHL89321
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaagauauucugcggacccaggagucugaaugugugugcaucaaugggacauguacggucguuaugaccgacggauccgcuagcggcaaggccgauacaaaaauucucuuuaucgaggaggggaagaucgugcacauuuccacccugucuggaagcgcgcaacacguggaagagugcuccugcuauccucgcuaccccggcgucagaugugugugccgggacaacuggaaggggagcaaccgcccuaucguugacauuaauaucaaaaacuacucuauuguguccagcuaugucuguucuggacuugugggcgauacacccagaaagaccgacagcuccucuagcucccauugccuggauccgaauaacgaagagggcgggcacggaguuaaaggcugggccuucgacgaugggaaugacguguggaugggacggacgaucagcgaaaagcuccgccugggcuacgagacauuuaaagucaucgagggguggucuaacccuaauuccaagcugcagauuaacagacaggugaucgucgaucggggaaaucgcagcggcuauucuggcauuuucuccguggaagggaaaagcuguaucaacagaugcuuuuacguugagcucauucggggaagaaaggaagagaccgaagugcuguggaccuccaauucuaucgucguguucuguggcacaagcgggaccuauggaacaggcuccuggcccgacggggcugauauuaaccuuaugccuaucuga

SEQ ID NO: 207558 - RNA, 1410 nt, Artificial Sequence
  derived and/or modified sequence opt5 from neuraminidase__InfluenzaA__AHL89333
augaaccccaaucagaagaucauuaccaucggcagcgugucccugacaauuucuacgaucugcuucuuuaugcaaauugccauccucaucgcuaccgucacacugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacucgccgaguaccggaauugguccaagccccaguguaacauuacgggguucgcgccuuuuucuaaagacaauagcauccgccuguccgcuggaggcgauaucugggugaccagagagcccuaugucucuugcgacccugauaaguguuaccaauucgcccuugggcagggaacaacccugaacaaugugcauagcaacgacacaguucacgaucggaccccguaucgcacgcuccugaugaaugaacugggcgugcccuuucaucucgggacaaagcaggucugcauugccugguccucuagcuccugucacgacggaaaggcuuggcugcaugugugcguuaccggcgaugacaaaaacgccacagcuagcuucaucuacaauggcagacuuguggauucuauugucuccuggagcaaagagauccugcggacccaggaaucugagugugugugcauuaacgggaccugugccguggucaugacagacggauccgcgagcggcaaggccgauacgaaaauccucuuuaucgaggaagggaagauuguucacaccuccacacugucuggaagcgcucaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacaaucagcgagaagcuccgccugggcuacgagaccuuuaaagugaucgaaggguggucuaauccuaacuccaagcugcagacgaauagacaggucauuguggaccggggaaaccgcagcggcuauucuggcaucuucuccgucgaggggaaaagcuguauuaauagaugcuuuuacguggaacucauccggggaagaaaggaggaaacagagguucuguggaccuccaacucuauuguggucuucuguggcaccagcgggacauauggaaccggcuccuggcccgauggggcugacaucaaucuuaugccuauuuga

SEQ ID NO: 207559 - RNA, 1410 nt, Artificial Sequence; identical to SEQ ID NO: 197736
  derived and/or modified sequence opt5 from neuraminidase__InfluenzaA__AHL89345

SEQ ID NO: 207560 - RNA, 1410 nt, Artificial Sequence; identical to SEQ ID NO: 198730
  derived and/or modified sequence opt5 from neuraminidase__InfluenzaA__AHL89357

SEQ ID NO: 207561 - RNA, 1410 nt, Artificial Sequence; identical to SEQ ID NO: 198731
  derived and/or modified sequence opt5 from neuraminidase__InfluenzaA__AHL89369

SEQ ID NO: 207562 - RNA, 1410 nt, Artificial Sequence
  derived and/or modified sequence opt5 from neuraminidase__InfluenzaA__AHL89381
augaaccccaaucagaagaucauuaccaucggcagcgugucccugacaauuucuacgaucugcuucuuuaugcaaauugccauccucaucaccacagucacccugcacuucaaacaguacgaguauaacagcccuccgaauaaccagguuaugcuuugugaacccacaauuaucgagagaaauauuaccgaaaucguguaccugacaaacaccacgauugagaaggaaaucugcccuaaacucgcugaguaucggaauugguccaagccccaguguaacauuaccggguuugccccuuucucuaaagacaauagcauccgccuguccgcgggaggcgauaucugggugacaagagagcccuacgucucuugcgacccugauaaguguuaucaauuugcucuugggcagggaaccacacugaacaaugugcauagcaacgacaccguucacgaucggacgccguaccgcacacuccugaugaaugaacugggcgugcccuuccaucucgggaccaagcaggucugcauugccugguccucuagcuccugucacgacggaaaagccuggcugcaugugugcguuacaggcgaugacaagaacgcuaccgccagcuuuaucuauaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuucaucgaggaagggaagauuguucacaccuccacacugucuggaagcgcgcaacacguggaggaaugcuccugcuacccucgcuaccccggcgugagaugugucugccgggacaacuggaaggggagcaaucgcccuaucguggauauuaacaucaaagacuauucuauuguuuccagcuacguguguucuggacuugucggcgacacccccagaaagaaugauagcuccucuagcucccauugccuggacccgaacaaugaggaaggcgggcacggagugaaaggcugggccuuugaugacgggaacgauguuuggaugggacggacgaucagcgagaagcuccgccugggcuaugagacauucaaagugaucgaaggguggucuaauccuaacuccaagcugcagaccaauagacaggucauuguggaccggggaaaccgcagcggcuacucuggcaucuuuuccgucgaggggaaaagcuguauuaauagaugcuucuauguggaacucauccggggaagaaaggaggaaaccgagguucuguggacauccaacucuauuguggucuuuuguggcaccagcgggacauacggaacgggcuccuggcccgauggggcugacaucaaucuuaugccuauuuga

SEQ ID NO: 207563 - RNA, 1410 nt, Artificial Sequence; identical to SEQ ID NO: 207553
  derived and/or modified sequence opt5 from neuraminidase__InfluenzaA__AHL89405

SEQ ID NO: 207564 - RNA, 1410 nt, Artificial Sequence
  derived and/or modified sequence opt5 from neuraminidase__InfluenzaA__AHL89417
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaagauauucugcggacccaggagucugaaugugugugcaucaaugggacauguacggucguuaugaccgacggauccgcuagcggcaaggccgauacaaaaauucucuuuaucgaggaggggaagaucgugcacaccuccacacugucuggaagcgcgcaacacguggaagagugcuccugcuauccucgcuaccccggcgucagaugugugugccgggacaacuggaaggggagcaaccgcccuauuguugacaucgauauuaaaaauuacucuaucguguccagcuaugucuguucuggacuugugggcgacacccccagaaagacggauagcuccucuagcucccauugccuggacccgaacaaugaagagggcgggcacggaguuaaaggcugggccuucgaugacgggaacgauguguggaugggacggacaauuagcgaaaagcuccgccugggcuacgagaccuuuaaagucaucgagggguggucuaauccuaacuccaagcugcagaucaauagacaggugauugucgaccggggaaaccgcagcggcuauucuggcaucuucuccguggaagggaaaagcuguauuaauagaugcuuuuacguugagcucauccggggaagaaaggaagagaccgaagugcuguggacauccaacucuauugucguguucuguggcaccagcgggacauauggaacgggcuccuggcccgauggggcugacaucaaucuuaugccuauuuga

SEQ ID NO: 207565 - RNA, 1410 nt, Artificial Sequence; identical to SEQ ID NO: 198731
  derived and/or modified sequence opt5 from neuraminidase__InfluenzaA__AHL89429

SEQ ID NO: 207566 - RNA, 1410 nt, Artificial Sequence; identical to SEQ ID NO: 197736
  derived and/or modified sequence opt5 from neuraminidase__InfluenzaA__AHL89441

SEQ ID NO: 207567 - RNA, 1410 nt, Artificial Sequence; identical to SEQ ID NO: 197736
  derived and/or modified sequence opt5 from neuraminidase__InfluenzaA__AHL89453

SEQ ID NO: 207568 - RNA, 1410 nt, Artificial Sequence
  derived and/or modified sequence opt5 from neuraminidase__InfluenzaA__AHL89465
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacauuaccaucgagaaggaaaaaugcccuaagcucgcugaguaccggaauugguccaaaccccaguguaacauuacgggguucgccccuuuuucuaaggacaauagcauccgccuguccgcgggaggcgauaucugggugaccagagagcccuaugucucuugcgacccugaucgguguuaccaauucgcucuugggcagggaacaacccugaacaaugugcauagcaacgacacaguucacgaucgcaccccguauagaacgcuccugaugaaugaacugggcgugcccuuucaucucgggacaaagcaggucugcauugccugguccucuagcuccugucacgacggaaaagccuggcugcaugugugcguuaccggcgaugacaagaacgcuacagccagcuucaucuacaauggccggcuuguggauucuauugucuccuggagcaaagagauccugcgcacccaggaaucugagugugugugcauuaacgggaccuguacaguggucaugacggacggauccgcuagcggcaaggccgauaccaaaauccucuuuaucgaggaagggaagauuguucacacauccacccugucuggaagcgcgcaacacguggaggaaugcuccugcuauccuagauaccccggcgugcggugugucugccgcgacaacuggaaggggagcaauagaccuaucguggauauuaacaucaaagacuacucuauuguuuccagcuauguguguucuggacuugucggcgacacaccccggaagaaugauagcuccucuagcucccauugccuggacccgaacaaugaggaaggcgggcacggagugaaaggcugggccuucgaugacgggaacgauguuuggaugggacgcaccaucagcgagaagcucagacugggcuacgagacguuuaaagugaucgaaggguggucuaauccuaacuccaagcugcagacaaaucggcaggucauuguggaccgcggaaacagaagcggcuauucuggcaucuucuccgucgaggggaaaagcuguauuaaucggugcuuuuacguggaacucaucagaggacgcaaggaggaaaccgagguucuguggaccuccaacucuauuguggucuucuguggcacaagcgggaccuauggaacaggcuccuggcccgauggggcugacaucaaucuuaugccuauuuga

SEQ ID NO: 207569 - RNA, 1410 nt, Artificial Sequence; identical to SEQ ID NO: 207543
  derived and/or modified sequence opt5 from neuraminidase__InfluenzaA__AHL89477

SEQ ID NO: 207570 - RNA, 1410 nt, Artificial Sequence
  derived and/or modified sequence opt5 from neuraminidase__InfluenzaA__AHL89489
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguucuauuaccggguucgccccuuuuagcaaagacaacuccauccgccugucugcgggaggcgauaucugggugacaagagagcccuaugucagcugcgacccugauaaguguuaccaauucgcucuugggcagggaaccacacugaauaacgugcauuccaaugacaccguucacgaucggacgccguaucgcacacuccugaugaacgaacugggcgugcccuuucaucucgggaccaagcaggucugcauugccuggucuagcuccagcugucacgacggaaaagccuggcugcaugugugcguuacaggcgaugacaagaaugcuaccgccucuuucaucuacaacggcagacuuguggauuccauugucagcuggucuaaagagauccugcggacccaggaauccgagugugugugcauuaaugggacauguacgguggucaugaccgacggaagcgcuuccggcaaggccgauacaaaaauccucuuuaucgaggaagggaagauuguucacaccucuacacugagcggauccgcgcaacacguggaggaaugcagcugcuauccucgcuaccccggcgugagaugugucugccgggacaacuggaaggggucuaaccgcccuaucguggauauuaauaucaaagacuacuccauuguuagcucuuauguguguagcggacuugucggcgacacccccagaaagaacgaucgguccucuagcucccauugccuggacccgaauaacgaggaaggcgggcacggagugaaaggcugggccuucgaugacgggaaugauguuuggaugggacgcacgaucagcgagaagucuagauccggcuacgagacauuuaaagugaucgaaggguggagcaacccucauucuaagcuccagauuaaucggcaggucaucguggaccgcggaaacagauccggcuauagcggcauuuucuccgucgaggggaaaucuuguaucaaucggugcuuuuacguggaacugauuagaggacgcaaggaggaaaccgagguucuguggaccagcaacuccaucguggucuucuguggcacaucugggaccuauggaacaggcagcuggcccgauggggcugacauuaaucucaugccuaucuga

SEQ ID NO: 207571 - RNA, 1410 nt, Artificial Sequence; identical to SEQ ID NO: 198731
  derived and/or modified sequence opt5 from neuraminidase__InfluenzaA__AHL89501

SEQ ID NO: 207572 - RNA, 1410 nt, Artificial Sequence; identical to SEQ ID NO: 198731
  derived and/or modified sequence opt5 from neuraminidase__InfluenzaA__AHL89513

SEQ ID NO: 207573 - RNA, 1410 nt, Artificial Sequence; identical to SEQ ID NO: 198731
  derived and/or modified sequence opt5 from neuraminidase__InfluenzaA__AHL89525

SEQ ID NO: 207574 - RNA, 1410 nt, Artificial Sequence; identical to SEQ ID NO: 198731
  derived and/or modified sequence opt5 from neuraminidase__InfluenzaA__AHL89537

SEQ ID NO: 207575 - RNA, 1413 nt, Artificial Sequence
  derived and/or modified sequence opt5 from neuraminidase__InfluenzaA__AHL89549
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagcaucuugacuaccagauuggauauaucugcagcggcguuuuuggggauaacccucggcccaaagacggaaagggcucuuguaauccugugacaguggauggcgccgacggggucaaaggauucuccuacaaguauggcaacgggguguggauuggacgcacgaaaagcaauagacugcggaagggcuuugagaugaucugggaccccaacggguggaccgauacagacucugauuucuccguuaagcaagacguggucgcgauuaccgauuggagcggcuacuccggaucuuuugugcagcacccggaacucacaggccuggacugcauccgcccuuguuucuggguugagcuugugagagggcugccccgggaaaauaccacgaucuggacaagcggauccucuauuagcuucugcggcgucgauuccgacaccgccaacuggagcuggccugauggggcugagcuccccuuuaccaucgacaaauga

SEQ ID NO: 207576 - RNA, 1413 nt, Artificial Sequence; identical to SEQ ID NO: 199054
  derived and/or modified sequence opt5 from neuraminidase__InfluenzaA__AHL89561

SEQ ID NO: 207577 - RNA, 1413 nt, Artificial Sequence; identical to SEQ ID NO: 199054
  derived and/or modified sequence opt5 from neuraminidase__InfluenzaA__AHL89573

SEQ ID NO: 207578 - RNA, 1413 nt, Artificial Sequence; identical to SEQ ID NO: 199089
  derived and/or modified sequence opt5 from neuraminidase__InfluenzaA__AHL89585

SEQ ID NO: 207579 - RNA, 1413 nt, Artificial Sequence
  derived and/or modified sequence opt5 from neuraminidase__InfluenzaA__AHL89597
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguucgggaccgcucuccguauagagcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaguauaacggaaucauuacagaaaccaucaaaucuuggaagaaacggauucuccgcacgcaggaguccgagugcguuugugugaauggcagcugcuuuacaaucaugaccgauggccccucuaacggggcugccagcuacaagaucuucaaaauugaaaagggaaaggucacaaaauccaucgagcugaaugcuccuaacuuucacuaugaagaguguucuugcuacccggacaccggcaccgugaugugugugugcagagauaauuggcacgggagcaaccggcccugggucuccuucaaucagaaccuugacuaccagguuggauauauuugcagcggcguguuuggggauaauccucgccccaaggacggaaaaggcucuuguaacccuaugacaguggauggcgccgacggggucaagggauucuccuacaaauauggcaaugggguguggaucggaagaacgaaguccaacaaacugcggaagggcuuugagaugauuugggaccccaauggguggaccgauacagacucugauuucuccguuaagcaagacguggucgcgaucaccgauuggagcggcuacuccggaucuuuugugcagcauccggaacucacaggccuggacugcauucgcccuuguuucuggguugagcuugugagagggcugccccgggaaaacaccacgaucuggacaagcggauccucuaucagcuucugcggcgucgauuccgacaccgccaauuggagcuggccugauggggcugagcuccccuuuaccauugacaaauga

SEQ ID NO: 207580 - RNA, 1413 nt, Artificial Sequence; identical to SEQ ID NO: 199089
  derived and/or modified sequence opt5 from neuraminidase__InfluenzaA__AHL89609

SEQ ID NO: 207581 - RNA, 1413 nt, Artificial Sequence
  derived and/or modified sequence opt5 from neuraminidase__InfluenzaA__AHL89621
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacaucggaagggcuuugagaugaucugggaccccaacggguggaccgauacagacuccgauuucagcguuaagcaagacguggucgcgauuaccgauugguccggcuacucuggauccuuugugcagcacccggaacugacaggccucgacugcauccgcccuuguuucuggguugagcuggugagagggcuuccccgggaaaauaccacgaucuggacauccggaucuagcauuuccuucugcggcgucgauagcgacaccgccaacuggucuuggccugauggggcugagcugcccuuuaccaucgacaaauga

SEQ ID NO: 207582 - RNA, 1413 nt, Artificial Sequence; identical to SEQ ID NO: 199080
  derived and/or modified sequence opt5 from neuraminidase__InfluenzaA__AHL89633

SEQ ID NO: 207583 - RNA, 1413 nt, Artificial Sequence; identical to SEQ ID NO: 199089
  derived and/or modified sequence opt5 from neuraminidase__InfluenzaA__AHL89645

SEQ ID NO: 207584 - RNA, 1413 nt, Artificial Sequence; identical to SEQ ID NO: 199054
  derived and/or modified sequence opt5 from neuraminidase__InfluenzaA__AHL89657

SEQ ID NO: 207585 - RNA, 1413 nt, Artificial Sequence
  derived and/or modified sequence opt5 from neuraminidase__InfluenzaA__AHL89669
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacaguggauggcgccgacggggucaaaggauucuccuacaaguauggcaaugggguguggaucggacgcacgaaaagcaacgagcugagaaagggcuuugaaaugauuugggaccccaauggguggaccgauacagacucugauuucuccguuaagcaagacguggucgcgaucaccgauuggagcggcuacuccggaucuuuugugcagcauccggagcucacaggccuggacugcauucggccuuguuucuggguugaacuugugcgcgggcugcccagagagaacaccacgaucuggacaagcggauccucuaucagcuucugcggcgucgauuccgacaccgccaauuggagcuggccugauggggcugaacuccccuuuaccauugacaaauga

SEQ ID NO: 207586 - RNA, 1413 nt, Artificial Sequence
  derived and/or modified sequence opt5 from neuraminidase__InfluenzaA__AHL89681
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaaaucacaaaguccauugagcugaaugcuccuaacuuucacuaugaagaguguucuugcuacccggacaccggcaccgucaugugugugugccgcgauaauuggcacgggagcaacagacccuggguguccuucaaucagaaccuugacuaccaggucggauauaucugcagcggcguuuuuggggauaauccucggcccaaagacggaaagggcucuuguaacccuaugacaguggauggcgccgacggggugaaaggauucuccuacaaguauggcaauggggucuggauuggacgcacgaaaagcaacaagcugagaaagggcuuugagaugaucugggaccccaauggguggaccgauacagacucugauuucuccgugaaacaagacguuguggcgauuaccgauuggagcggcuacuccggaucuuuuguccagcauccggaacucacaggccuggacugcauccggccuuguuucuggguggagcuuguucgcgggcugcccagagaaaacgccaccaucuggacgagcggauccucuauuagcuucugcggcguggauuccgacacagcuaauuggagcuggccugauggggccgagcuccccuuuaccaucgacaaguga

SEQ ID NO: 207587 - RNA, 1413 nt, Artificial Sequence
  derived and/or modified sequence opt5 from neuraminidase__InfluenzaA__AHL89693
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaagggaaucauuacaggcaccaucaaaucuuggagaaagcagauucuccggacgcaggaauccgagugcguuuguaugaacggcagcugcuuuacaaucaugaccgaugggcccucuaauggagcugccagcuacaaaaucuucaagauugagaagggcaaagugacaaaguccaucgaacugaacgcuccuaauuuucacuaugaggaauguucuugcuacccggacaccgggauugucaugugugugugccgcgauaacuggcacggaagcaauagacccuggguguccuucaaccagaaucuugacuaccaaaucggcuauauuugcagcggggucuuuggagauaacccucggcccaaagacggcgagggcucuuguaauccuguuaccguggauggggccgacggagugaagggcuucuccuacaaauaugacgauggggucuggaucggacgcacaaagagcaacagacugcggaaaggcuuugagaugauuugggaccccaauggguggacgaacaccgauucugacuucuccgugaagcaggauguuguggcgaucacagacuggagcggcuacuccggaucuuuuguccagcauccggaacucaccggccuggauugcauccgcccuuguuucuggguggagcuuguuagagggcugccccgggaaaauacaaccauuuggacgagcggauccucuaucagcuucugcggcgugaacuccgacacagccaauuggagcuggccugauggggcugagcuccccuuuaccauugacaaguga

SEQ ID NO: 207588 - RNA, 1413 nt, Artificial Sequence
  derived and/or modified sequence opt5 from neuraminidase__InfluenzaA__AHL89705
augaaccccaaucagaagaucauuaccaucggcagcauuuccaucgccauugggaucaucucucugaugcuccaaauuggaaacaucauuagcaucugggcuucccacucuauucagaauggcagccagaaccauacagggaucugcaaucagagaauuaucacguacgagaacuccaccugggugaaucacacauaugucucuaucaacaauaccaacguuguggccggaaaagacaagacaagcgugacccuggcgggcaauuccagccuuuguucuauuuccgggugggcuaucuacacaaaagauaacagcauucggaucggaucuaagggcgacgucuucgugauucgcgaaccuuuuaucuccugcagccaucuggaguguagaaccuucuuucucacgcaaggcgcccugcuuaaugauaaacacucuaacgggaccguuaaggaccgguccccguaucgcgcccugaugagcugcccccucggagaagcuccuucccccuacaauucuaaguucgagagcguggccugguccgcuagcgccugucaugauggcaugggguggcugacaaucggaauuucuggcccugacaacggggcggucgccgugcugaaauauaacggaaucauuaccgaaacaaucaaguccuggaaaaagcggauucucagaacccaggagagcgagugcguuugugugaauggcucuugcuuuacgaucaugacagauggccccagcaacggggcugccuccuacaaaaucuucaagauugaaaagggaaaagucaccaagucuaucgagcugaaugcuccuaacuuucacuaugaagaguguagcugcuacccggacacaggcaccgugaugugugugugccgcgauaauuggcacggguccaacagacccugggucagcuucaaucagaaccuugacuaccagauuggauauaucugcucuggcguuuuuggggauaauccucggcccaaagacggaaagggcuccuguaacccugugaccguggauggcgccgacggggucaaaggauucagcuacaaguauggcaaugggguguggauuggacgcacaaaaucuaacagacugcggaagggcuuugagaugaucugggaccccaauggguggacggauaccgacuccgauuucagcguuaagcaagacguggucgcgauuacagauugguccggcuacucuggcagcuuugugcagcauccggaacucaccggacuggacugcauccgcccuuguuucuggguugagcuugugagagggcugccccgggaaaacacaaccaucuggacguccggaucuagcauuuccuucugcggcgucgauagcgacacagccaauuggucuuggccugauggggcugagcuccccuuuaccaucgacaaauga

SEQ ID NO: 207589 - RNA, 1413 nt, Artificial Sequence; identical to SEQ ID NO: 199054
  derived and/or modified sequence opt5 from neuraminidase__InfluenzaA__AHL89717

SEQ ID NO: 207590 - RNA, 1413 nt, Artificial Sequence; identical to SEQ ID NO: 199054
  derived and/or modified sequence opt5 from neuraminidase__InfluenzaA__AHL89729

SEQ ID NO: 207591 - RNA, 1413 nt, Artificial Sequence
  derived and/or modified sequence opt5 from neuraminidase__InfluenzaA__AHL89753
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaacgacaaaaccagcgugacacuggcgggcaauuccagccuuuguucuauuuccgggugggcuaucuacaccaaggauaacagcauucggaucggaucuaaaggcgacgucuucgugauucgcgaaccuuuuaucuccugcagccaucuggaguguagaacguucuuucucacccaaggcgcccugcuuaaugauaagcacucuaacgggacaguuaaagaccgguccccguaucgcgcccugaugagcugcccccucggagaagcuccuucccccuacaauucuaaguucgagagcguggccugguccgcuagcgccugucaugauggcaugggguggcugaccaucggaauuucuggcccugacaacggggcggucgccgugcugaaguauaacggaaucauuacagaaaccaucaaauccuggaagaaacggauucucagaacgcaggagagcgagugcguuugugugaauggcucuugcuuuacaaucaugaccgauggccccagcaacggggcugccuccuacaagaucuucaaaauugaaaagggaaaggucacaaaaucuaucgagcugaaugcuccuaacuuucacuaugaagaguguagcugcuacccggacaccggcaccgugaugugugugugccgcgauaauuggcacggguccaacagacccugggucagcuucaaucagaaccuugacuaccagauuggauauaucugcucuggcguuuuuggggauaauccucggcccaaggacggaaaaggcuccuguaacccugugacaguggauggcgccgacggggucaagggauucagcuacaaauauggcaaugggguguggauuggacgcacgaagucuaacagacugcggaaaggcuuugagaugaucugggaccccaauggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaacaccacgaucuggacauccggaucuagcauuuccuucugcggcgucgauagcgacaccgccaauuggucuuggccugauggggcugagcuccccuuuaccaucgacaaguga

SEQ ID NO: 207592 - RNA, 1413 nt, Artificial Sequence; identical to SEQ ID NO: 199054
  derived and/or modified sequence opt5 from neuraminidase__InfluenzaA__AHL89765

SEQ ID NO: 207593 - RNA, 1413 nt, Artificial Sequence; identical to SEQ ID NO: 199095
  derived and/or modified sequence opt5 from neuraminidase__InfluenzaA__AHL89777

SEQ ID NO: 207594 - RNA, 1413 nt, Artificial Sequence; identical to SEQ ID NO: 199054
  derived and/or modified sequence opt5 from neuraminidase__InfluenzaA__AHL89789

SEQ ID NO: 207595 - RNA, 1413 nt, Artificial Sequence
  derived and/or modified sequence opt5 from neuraminidase__InfluenzaA__AHL89801
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucuguggcgcuggcuggcaauagcucccuuuguagcauuucugggugggccaucuacacaaaagauaacuccauucggaucggaagcaagggcgacgucuucgugauucgcgagccuuuuaucucuugcucccaucuggaguguagaaccuucuuucucacgcaaggcgcccugcuuaaugauaaacacagcaacgggaccguuaaggaccggucuccguaucgcgcucugauguccugcccccucggagaagccccuagccccuacaauuccaaguucgagucuguggcuuggagcgccuccgcgugucaugauggcaugggguggcugacaaucggaauuagcggcccugacaacggggccgucgcugugcugaaauauaacggaaucauuaccgaaacaaucaagucuuggaaaaagcggauucucagaacccaggaguccgagugcguuugugugaauggcagcugcuuuacgaucaugacagauggccccucuaacggggccgcuagcuacaaaaucuucaagauugaaaagggaaaagucaccaaguccaucgagcugaaugccccuaacuuucacuaugaagaguguucuugcuacccggacacaggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugaccguggauggcgcggacggggucaaaggauucuccuacaaguauggcaaugggguguggauuggacgcacaaaaagcaacagacugcggaagggcuuugagaugaucugggaccccaauggguggacgaacaccgauucugacuucuccguuaagcaagauguggucgccauuacagacuggagcggcuacuccggaucuuuugugcagcauccggaacucaccggccuggauugcauccgcccuuguuucuggguugagcuugugagagggcugccccgggaaaauacaaccaucuggacgagcggauccucuauuagcuucugcggcgucgacuccgauacagcuaacuggagcuggccugacggggccgagcuccccuuuaccaucgauaaauga

SEQ ID NO: 207596 - RNA, 1413 nt, Artificial Sequence
  derived and/or modified sequence opt5 from neuraminidase__InfluenzaA__AHL89813
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacagccgauggcgcggacggggugaaaggauucuccuacaaguauggcaauggggucuggaucggacgcacgaaaagcaacaagcugagaaagggcuuugagaugauuugggaccccaauggguggaccgauacagacucugauuucuccgugaaacaagacguuguggccaucaccgauuggagcggcuacuccggaucuuuuguccagcauccggaacucacaggccuggacugcauucggccuuguuucuggguggagcuuguucgcgggcugcccagagaaaacgcuaccaucuggacgagcggauccucuaucagcuucugcggcguggauuccgacacagccaauuggagcuggccugauggggcugagcuccccuuuaccauugacaaguga

SEQ ID NO: 207597 - RNA, 1413 nt, Artificial Sequence; identical to SEQ ID NO: 199095
  derived and/or modified sequence opt5 from neuraminidase__InfluenzaA__AHL89825

SEQ ID NO: 207598 - RNA, 1413 nt, Artificial Sequence; identical to SEQ ID NO: 199054
  derived and/or modified sequence opt5 from neuraminidase__InfluenzaA__AHL89837

SEQ ID NO: 207599 - RNA, 1413 nt, Artificial Sequence
  derived and/or modified sequence opt5 from neuraminidase__InfluenzaA__AHL89849
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucuacaucaauaacacaaauguuguggccggaaaagacaagaccucugugacacuggcgggcaacagcucccuuuguagcauuucugggugggcuaucuauaccaaagauaauuccauucggaucggaagcaagggcgacgucuucgugauucgcgaaccuuuuaucucuugcucccaucuggaguguagaacguucuuucucacccaaggcgcccugcuuaacgauaaacacagcaaugggacaguuaaggaccggucuccguaccgcgcccugauguccugcccccucggagaagcuccuagccccuauaacuccaaguucgagucuguggccuggagcgcuuccgccugucaugauggcaugggguggcugaccaucggaauuagcggcccugacaauggggcggucgccgugcugaaauacaacggaaucauuacagaaaccaucaagucuuggaaaaagcggauucucagaacgcaggaguccgagugcguuugugugaacggcagcugcuuuacaaucaugaccgauggccccucuaauggggcugccagcuauaaaaucuucaagauugaaaagggaauggucacaaaauccaucgagcugaacgcuccuaauuuucacuacgaagaguguucuugcuacccggacaccggcaccgugaugugugugugccgcgauaacuggcacgggagcaauagacccugggucuccuucaaccagaaucuugacuaucagauuggauacaucugcagcggcguuuuuggggauaacccucggcccaaggacggaaaaggcucuuguaauccugugacaguggauggcgccgacggggucaagggauucuccuauaaauacggcaacgggguguggauuggacgcacgaaguccaauagacugcggaaaggcuuugagaugaucugggaccccaacggguggaccaauacagauucugacuucuccguuaagcaagauguggucgcgauuaccgacuggagcggcuauuccggaucuuuugugcagcauccggaacucacaggccuggauugcauccgcccuuguuucuggguugagcuugugagagggcugccccgggaaaacaccacgaucuggacaagcggauccucuauuagcuucugcggcgucgacuccgauaccgccaauuggagcuggccugacggggcugagcuccccuuuaccaucgauaaguga

SEQ ID NO: 207600 - RNA, 1410 nt, Artificial Sequence; identical to SEQ ID NO: 199090
  derived and/or modified sequence opt5 from neuraminidase__InfluenzaA__AHL89861

SEQ ID NO: 207601 - RNA, 1410 nt, Artificial Sequence
  derived and/or modified sequence opt5 from neuraminidase__InfluenzaA__AHL89873
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagagauccugcgcacacaggaaucugagugugucugcauuaaugggacguguaccguggugaugacagauggauccgcuagcggcaaggccgacaccaaaauccucuuuaucgaggaagggaagauuguccauacauccacccugucuggaagcgcgcaacacguugaggaaugcuccugcuauccuagauaccccggcgugcggugugugugccgcgauaacuggaaggggagcaacagaccuaucgucgacauuaauaucaaagaccacucuauuguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcacaaucagcgagaagucuagacucggcuaugagaccuuuaaaguuaucgaagggugguccaacccuaagagcaaacugcagauuaaucgccaggugaucgucgauggaggcaaccggucuggcuacuccgggauuuucagcguggagggaaaguccuguaucaauagaugcuuuuaugucgaacugauucggggcagaaaggaggaaaccgaggugcucuggacaucuaacagcaucguuguguucugugggaccuccggaacauacggcacggggucuuggcccgacggcgcugauauuaaucugaugccuaucuga

SEQ ID NO: 207602 - RNA, 1410 nt, Artificial Sequence; identical to SEQ ID NO: 199767
  derived and/or modified sequence opt5 from neuraminidase__InfluenzaA__AHL89885

SEQ ID NO: 207603 - RNA, 1410 nt, Artificial Sequence
  derived and/or modified sequence opt5 from neuraminidase__InfluenzaA__AHL89897
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaccaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggacaucuaacagcaucguuguguucuguggcaccuccgggacauacggaacgggcucuuggcccgacggggcugauauuaaucugaugccuaucuga

SEQ ID NO: 207604 - RNA, 1410 nt, Artificial Sequence; identical to SEQ ID NO: 199426
  derived and/or modified sequence opt5 from neuraminidase__InfluenzaA__AHL89909

SEQ ID NO: 207605 - RNA, 1410 nt, Artificial Sequence; identical to SEQ ID NO: 199065
  derived and/or modified sequence opt5 from neuraminidase__InfluenzaA__AHL89921

SEQ ID NO: 207606 - RNA, 1410 nt, Artificial Sequence; identical to SEQ ID NO: 199426
  derived and/or modified sequence opt5 from neuraminidase__InfluenzaA__AHL89933

SEQ ID NO: 207607 - RNA, 1410 nt, Artificial Sequence; identical to SEQ ID NO: 199065
  derived and/or modified sequence opt5 from neuraminidase__InfluenzaA__AHL89945

SEQ ID NO: 207608 - RNA, 1410 nt, Artificial Sequence
  derived and/or modified sequence opt5 from neuraminidase__InfluenzaA__AHL89957
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauuaaggaggggaagaucguccauaccuccacacugucuggaagcgcgcaacacguugaagagugcuccugcuauccuagauaccccggcgugcggugugugugccgcgauaacuggaaagggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgaaaaaucuagacucggcuaugagacauuuaagguuauugaggggugguccaacccuaaaagcaagcugcagaucaaucgccaggugauugucgaucggggaaacagaucuggcuacuccggcaucuucagcguggaagggaaguccuguauuaaucggugcuuuuaugucgagcugaucagaggacgcaaagaagagaccgaagugcucuggaccucuaacagcauuguuguguucuguggcacauccgggaccuacggaacaggcucuuggcccgacggggcugauaucaaucugaugccuaucuga

SEQ ID NO: 207609 - RNA, 1410 nt, Artificial Sequence; identical to SEQ ID NO: 198908
  derived and/or modified sequence opt5 from neuraminidase__InfluenzaA__AHL89969

SEQ ID NO: 207610 - RNA, 1410 nt, Artificial Sequence; identical to SEQ ID NO: 198908
  derived and/or modified sequence opt5 from neuraminidase__InfluenzaA__AHL89981

SEQ ID NO: 207611 - RNA, 1410 nt, Artificial Sequence
  derived and/or modified sequence opt5 from neuraminidase__InfluenzaA__AHL89993
augaaccccaaucagaagaucauuaccaucggcagcgugucccugucuauuagcacaaucugcuucuuuaugcaaauugccauccucaucacgaccgucacacugcacuucaaacaguacgaguuuaacuccccuccgaauaaccagguuaugcuuugugaacccaccauuaucgagagaaauauuacagaaaucguguaucugaccaacacaaccauugagaaggaaaucugcccuaaacucgcugaguaccggaauuggucuaagccccagugugacauuacgggguucgccccuuuuagcaaagauaacuccauccgccugucugcgggaggcgacaucugggugaccagagagcccuaugucagcugcgauccugacaaguguuaccaauucgcucuugggcagggaacaacccugaauaacgugcauuccaaugauacaguucgggaccgcaccccguauagaacgcuccugaugaacgaacugggcgugcccuuucaccucgggacaaagcaggucugcauugccuggucuagcuccagcugucaugauggaaaagccuggcugcacgugugcaucaccggcgacgauaagaaugcuacagccucuuucauuuacaacggccggcuuguugacuccaucgugagcuggucuaaagagauucugcgcacccaggaauccgagugugucugcaucaaugggaccuguacacucgugaugacggauggaagcgcuuccggcaaggccgacaccaaaauccuguuuauugaggaagggaagaucgugcauacaucuacccuuagcggauccgcgcaacacgucgaggaaugcagcugcuauccuagauaccccggcguucggugugugugccgcgauaacuggaaggggucuaacagaccuauuguggacaucaauauuaaagaccacuccaucgucagcucuuacguguguagcggacugguuggcgauacaccccggaagaacgacuccucuagcuccagccauugccucgauccgaauaacgaggaaggcgggcacggagugaaaggcugggccuucgacgaugggaaugacgucuggaugggacgcaccaucucugagaaguccagacugggcuaugagacguuuaaagugauugaaggguggagcaacccuaagucuaaacugcagaucaaucggcagguuauuguggaucgcggaaacagauccggcuacagcggcaucuucuccgucgaggggaagucuuguauuaaucggugcuuuuauguggaacucaucagaggacgcaaggaggaaacagagguccuguggaccagcaacuccauugugguuuucuguggcaccucugggacauacggaaccggcagcuggcccgacggggcugauaucaaucuuaugccuaucuga

SEQ ID NO: 207612 - RNA, 1410 nt, Artificial Sequence
  derived and/or modified sequence opt5 from neuraminidase__InfluenzaA__AHL90005
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucaagagaaacauuaccgagaucguguaucugacaaauaccacgauugaaaaagagaucugcccuaagcucgcugaauaccggaacuggucuaaaccccagugugacauuaccggguucgccccuuuuagcaaggauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugagcugggcgugcccuuucaucucgggaccaaacaggucugcauugccuggagcagcuccagcugucacgauggaaaggccuggcugcaugugugcguuacaggcgacgauaaaaacgcuaccgccucuuucaucuacaauggcagacuuguggacuccauugucagcuggucuaaggaaauccugcggacccaggaguccgaaugugugugcauuaacgggacauguacgguggucaugaccgauggaagcgcuuccggcaaagccgacacaaagauccucuuuaucgaggaggggaagauuguucacaccucuacacugagcggauccgcgcaacacguggaagagugcagcugcuauccucgcuaccccggcgugagaugugucugccgggauaauuggaaagggucuaaccgcccuaucguggacauuaacaucaaggacuacuccauuguuagcagauauguguguucuggacuugucggcgauacgccccggaaaaaugacagcuacuccucuagccauugccuggauccgaacaaugaagagggcgggcacggagugaagggcugggccuucgacgaugggaacgacguuuggaugggacgcaccaucuccgaaaaaucuagaucuggcuaugagacauuuaaggugaucgaggggugguccaauccuaacagcaaacuccagauuaaucggcaggucaucguggaucgcggaaacagaucuggcuacuccggcauuuucagcgucgaagggaaguccuguaucaaucggugcuuuuauguggagcugauuagaggacgcaaggaagagaccgaaguucuguggaccucuaacagcaucguggucuucuguggcacauccgggaccuacggaacaggcucuuggcccgacggggcugauauuaaucucaugccuaucuga

SEQ ID NO: 207613 - RNA, 1410 nt, Artificial Sequence; identical to SEQ ID NO: 199114
  derived and/or modified sequence opt5 from neuraminidase__InfluenzaA__AHL90017

SEQ ID NO: 207614 - RNA, 1410 nt, Artificial Sequence; identical to SEQ ID NO: 199065
  derived and/or modified sequence opt5 from neuraminidase__InfluenzaA__AHL90029

SEQ ID NO: 207615 - RNA, 1410 nt, Artificial Sequence; identical to SEQ ID NO: 199081
  derived and/or modified sequence opt5 from neuraminidase__InfluenzaA__AHL90041

SEQ ID NO: 207616 - RNA, 1410 nt, Artificial Sequence; identical to SEQ ID NO: 199081
  derived and/or modified sequence opt5 from neuraminidase__InfluenzaA__AHL90053

SEQ ID NO: 207617 - RNA, 1410 nt, Artificial Sequence; identical to SEQ ID NO: 205346
  derived and/or modified sequence opt5 from neuraminidase__InfluenzaA__AHL90065

SEQ ID NO: 207618 - RNA, 1410 nt, Artificial Sequence; identical to SEQ ID NO: 207608
  derived and/or modified sequence opt5 from neuraminidase__InfluenzaA__AHL90077

SEQ ID NO: 207619 - RNA, 1410 nt, Artificial Sequence; identical to SEQ ID NO: 199090
  derived and/or modified sequence opt5 from neuraminidase__InfluenzaA__AHL90089

SEQ ID NO: 207620 - RNA, 1410 nt, Artificial Sequence; identical to SEQ ID NO: 199767
  derived and/or modified sequence opt5 from neuraminidase__InfluenzaA__AHL90101

SEQ ID NO: 207621 - RNA, 1410 nt, Artificial Sequence; identical to SEQ ID NO: 199065
  derived and/or modified sequence opt5 from neuraminidase__InfluenzaA__AHL90113

SEQ ID NO: 207622 - RNA, 1413 nt, Artificial Sequence; identical to SEQ ID NO: 199656
  derived and/or modified sequence opt5 from neuraminidase__InfluenzaA__AHL90125

SEQ ID NO: 207623 - RNA, 1413 nt, Artificial Sequence
  derived and/or modified sequence opt5 from neuraminidase__InfluenzaA__AHL90136
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacagcggcauggucaugugugugugccgggauaacuggcauggguccaaucgccccugggugagcuucaaccagaaucuugacuaucaaauuggauacaucugcucuggcgucuuuggggauaacccuagacccgaggacggagaaggcuccuguaauccuguuaccguggauggcgccaacggggugaaaggauucagcuauaaguacggcaauggggucuggauuggacggaccaaaucuaaccgccugagaaagggcuuugagaugaucugggaccccaauggguggacaaacacggacuccgauuucagcgugaaacaggacguuguggcgauuaccgauugguccggcuauucuggcagcuuuguccagcacccggaacucacaggacuggacugcauccggccuuguuucuggguggagcuuguucgcgggcugcccagagaaaacaccacaaucuggaccuccggaucuagcauuuccuucugcggcgugaauagcgauacggccaacuggucuuggccugacggggcugagcuccccuuuacaaucgauaaguga

SEQ ID NO: 207624 - RNA, 1413 nt, Artificial Sequence; identical to SEQ ID NO: 199656
  derived and/or modified sequence opt5 from neuraminidase__InfluenzaA__AHL90160

SEQ ID NO: 207625 - RNA, 1413 nt, Artificial Sequence
  derived and/or modified sequence opt5 from neuraminidase__InfluenzaA__AHL90172
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcaauuguaacccuguuaccguggauggcgccaauggggugaaaggauucucuuacaaguauggcaacggggucuggaucggacggacaaaauccaaucgccugagaaagggcuuugagaugauuugggaccccaacggguggacgaacaccgacagcgauuucucugugaaacaggacguuguggcgaucacagauugguccggcuacagcggauccuuuguccagcacccggaacucaccggccuggacugcauccggccuuguuucuggguggagcuuguucgcgggcugcccagagaaaauacaaccauuuggacgucuggaagcuccaucucuuucugcggcgugaacagcgauacagccaauugguccuggccugacggggcugagcuccccuuuaccauugauaaguga

SEQ ID NO: 207626 - RNA, 1413 nt, Artificial Sequence; identical to SEQ ID NO: 199656
  derived and/or modified sequence opt5 from neuraminidase__InfluenzaA__AHL90184

SEQ ID NO: 207627 - RNA, 1413 nt, Artificial Sequence; identical to SEQ ID NO: 202954
  derived and/or modified sequence opt5 from neuraminidase__InfluenzaA__AHL90196

SEQ ID NO: 207628 - RNA, 1413 nt, Artificial Sequence; identical to SEQ ID NO: 199656
  derived and/or modified sequence opt5 from neuraminidase__InfluenzaA__AHL90220

SEQ ID NO: 207629 - RNA, 1413 nt, Artificial Sequence
  derived and/or modified sequence opt5 from neuraminidase__InfluenzaA__AHL90232
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccgugaacggcgccaauggggugaaaggauucuccuacaaguaugauaacggcgucuggaucgggcggacaaaaagcaaucgccugagaaagggauuugagaugauuugggaccccaacggcuggacgaacaccgacucugauuucuccgugaaacaggacguuguggcgaucacagauuggagcggguacuccggcucuuuuguccagcacccggaacucaccggacuggacugcauccggccuuguuucuggguggagcuuguucgcggccugcccagagaaaauacaaccauuuggacgagcggguccucuaucagcuucugcggagugaacuccgauacagccaauuggagcuggccugacggcgcugagcuccccuuuaccauugauaaguga

SEQ ID NO: 207630 - RNA, 1413 nt, Artificial Sequence
  derived and/or modified sequence opt5 from neuraminidase__InfluenzaA__AHL90244
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuaugaccguugauggcgccaacggggugaaaggauucuccuacaaguaugacaauggcguguggaucgggcggacaaaaagcaaccgccugagaaagggauuugagaugauuugggaccccaauggcuggacgaacaccgauucugacuucuccgucaaacaggaugugguugcgaucacagacuggagcggguacuccggcucuuuugugcagcacccggaacucaccggacuggauugcauccggccuuguuucugggucgagcuugugcgcggccugcccagagaaaacacaaccauuuggacgagcggguccucuaucagcuucugcggaguuaauuccgacacagccagcuggucuuggccugauggcgcugagcuccccuuuaccauugacaaguga

SEQ ID NO: 207631 - RNA, 1413 nt, Artificial Sequence; identical to SEQ ID NO: 200485
  derived and/or modified sequence opt5 from neuraminidase__InfluenzaA__AHL90256

SEQ ID NO: 207632 - RNA, 1413 nt, Artificial Sequence
  derived and/or modified sequence opt5 from neuraminidase__InfluenzaA__AHL90268
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccagcauugucaugugugugugccgggauaacuggcacggcuccaaucgccccugggugagcuucaaccagaaucuugacuaccaaaucggguauauuugcucuggagucuuuggcgauaacccuagacccgaggacggggaaggauccuguaauccuguuaccguggauggcgccaacggcgugaaaggguucagcuacaaguaugacaauggagucuggaucggccggacaaaaucuaaccgccugagaaagggguuugagaugauuugggaccccaauggauggacgaacaccgaucgggacuucuccgugaaacaggauguuguggcgaucacagacuggagcggcuacuccgggucuuuuguccagcacccggaacucaccggccuggauugcauccgcccuuguuucuggguggagcuuguuagaggacugccccgggaaaacacaaccauuuggacgagcggcuccucuaucagcuucugcggggucaauuccgacacagccaacuggagcuggccugauggagcugagcuccccuuuaccauugacaaguga

SEQ ID NO: 207633 - RNA, 1413 nt, Artificial Sequence; identical to SEQ ID NO: 200485
  derived and/or modified sequence opt5 from neuraminidase__InfluenzaA__AHL90280

SEQ ID NO: 207634 - RNA, 1413 nt, Artificial Sequence
  derived and/or modified sequence opt5 from neuraminidase__InfluenzaA__AHL90304
augaaccccaaucagaagaucauuaccaucggcagcauuuccaucgccauugggaucaucucucugaugcuccaaauuggaaacaucauuagcaucugggcuucccacucuauucagacaggcagccagaauaacacggagaucugcaaucagagaauuaucaccuacgaaaacuccacaugggugaaucauaccuaugugaacaucaauaacacaaauguuguggccggggaggacaaaaccucugugacacuggcgggaaacagcucccuuuguagcauuucuggcugggcuaucuacaccaaggauaauuccauucggaucgggagcaaaggagacgucuucgugauucgcgaaccuuuuaucucuugcucccaccuggaguguagaacguucuuucucacccaaggcgcccugcuuaacgauaagcauagcaauggcacaguuaaagaccggucuccguaucgcgcccugauguccugcccccucggggaagcuccuagccccuacaacuccaaguucgagucuguggccuggagcgcuuccgccugucacgauggaaugggcuggcugaccaucgggauuagcggaccugacaacggcgcggucgccgugcugaaguauaaugggaucauuacaggaaccaucaaaucuuggaagaaacagauucucagaacgcaggaguccgaaugcguuuguaugaacggcagcugcuuuacaaucaugaccgauggccccucuaauaaggcugccagcuacaaaaucuucaagauugagaaggggaaagugacaaaguccaucgaacugaacgcuccuaauuuucauuaugaggaguguucuugcuacccggacaccggaauugucaugugugugugccgggauaacuggcacggcagcaaucgccccuggguguccuucaaccagaaucuugacuaccaaaucggguauauuugcagcggagucuuuggcgauaacccuagacccgaagacggggagggaucuuguaauccuguuaccguggauggcgccaacggcgugaaaggguucuccuacaaguaugacaauggagucuggaucggccggacaaaaagcaaccgccugagaaagggguuugaaaugauuugggaccccaauggauggacgaacaccgauucugacuucuccgugaaacaggauguuguggcgaucacagacuggagcggcuacuccgggucuuuuguccagcacccggagcucaccggccuggauugcauccggccuuguuucuggguggaacuuguucgcggacugcccagagagaacacaaccauuuggacgagcggcuccucuaucagcuucugcggggucaauuccgacacagccaacuggagcuggccugauggagcugagcuccccuuuaccauugacaaguga

SEQ ID NO: 207635 - RNA, 1413 nt, Artificial Sequence; identical to SEQ ID NO: 199656
  derived and/or modified sequence opt5 from neuraminidase__InfluenzaA__AHL90316

SEQ ID NO: 207636 - RNA, 1413 nt, Artificial Sequence
  derived and/or modified sequence opt5 from neuraminidase__InfluenzaA__AHL90328
augaaccccaauaagaaaaucauuaccaucggcagcauuuccaucgccauugggaucaucucucugaugcuccagauuggaaacaucauuagcaucugggcuucccacucuauucaaacaggcagccagaauaacacggggaucugcaaucagagaauuaucaccuacgagaacuccacaugggugaaucauaccuaugucaacaucaauaacacaaauguuguggccggagaagacaagaccucugugacacuggcgggcaacagcucccuuuguagcauuucugggugggcuaucuacaccaaagauaauuccauucggaucggaagcaagggcgacgucuucgugauucgcgagccuuuuaucucuugcucccaccuggaauguagaacguucuuucucacccagggcgcccugcuuaacgauaaacauagcaaugggacaguuaaggaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaauauaauggaaucauuacaggcaccaucaagucuuggaaaaagcaaauucucagaacgcaggaguccgagugcguuuguaugaacggcagcugcuuuacaaucaugaccgaugggcccucuaauaaagcugccagcuacaagaucuucaagauugaaaaaggaaaggugacaaaauccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccagaucggauauauuugcagcggcgucuuuggggauaacccuagacccgaggacggagaaggcucuuguaauccuguuaccguggauggcgccaacggggugaagggauucuccuacaaauaugacaauggcgucuggaucgggcggacaaagagcaaccgccugagaaaaggauuugagaugauuugggaccccaauggcuggacgaacaccgauucugacuucuccgugaagcaagauguuguggcggucacagacuggagcggguacuccggcucuuuugugcagcacccggaacucaccggacuggauugcauccggccuuguuucuggguugagcuugugcgcggccugcccagagaaaacacaaccaucuggacgagcggguccucuauuagcuucugcggagucaauuccgacacagccaacuggagcuggccugauggcgcugagcuccccuuuaccaucgacaaguga

SEQ ID NO: 207637 - RNA, 1413 nt, Artificial Sequence; identical to SEQ ID NO: 199656
  derived and/or modified sequence opt5 from neuraminidase__InfluenzaA__AHL90340

SEQ ID NO: 207638 - RNA, 1413 nt, Artificial Sequence
  derived and/or modified sequence opt5 from neuraminidase__InfluenzaA__AHL90352
augaaccccaaucagaagaucaugaccauuggcagcaucuccauugccaucgggauuaucucucugaugcuccaaaucggaaacauuaucagcauuugggcuucccacucuauccagacaggcagccagaauaacacggggauuugcaaucagagaaucauuaccuacgagaacuccacaugggugaaucauaccuaugucaacaucaauaacacaaauguuguggccggagaagacaaaaccucugugacacuggcgggcaacagcucccuuuguagcaucucugggugggcuauuuacaccaaggauaauuccauccggauuggaagcaaaggcgacgucuucgugauccgcgagccuuuuauuucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaaucagcggcccugacaacggggcggucgccgugcugaaguauaauggaauuaucacaggcaccauuaaaucuuggaagaaacagauccucagaacgcaggaguccgagugcguuuguaugaacggcagcugcuuuacaauuaugaccgaugggcccucuaauaaggcugccagcuacaaaaucuucaagaucgaaaagggaaaagugacaaaguccauugagcugaacgcuccuaauuuucauuaugaagaguguucuugcuacccggacaccggcaucgucaugugugugugccgggauaacuggcacgggagcaaucgccccuggguguccuucaaccagaaucuugacuaccaaauuggauauaucugcagcggcgucuuuggggauaacccuagacccgaggacggagaaggcucuuguuccccuguuaccguggauggcgccaauggggugaaaggauucagcuacaaguaugacaacggcgucuggauugggcggacaaaaucuaaucgccugagaaagggauuugagaugaucugggaccccaacggcuggacgaauaccgauuccgacuucagcgugaaacaggauguuguggcgauuacagacugguccggguacucuggcagcuuuguccagcacccggaacucaccggacuggauugcauccggccuuguuucuggguggagcuuguucgcggcaugcccagagaaaacacaaccaucuggacguccgggucuagcauuuccuucugcggagugaacagcgacacagccaauuggucuuggccugauggcgcugagcugcccuuuaccaucgacaaguga

SEQ ID NO: 207639 - RNA, 1413 nt, Artificial Sequence; identical to SEQ ID NO: 206485
  derived and/or modified sequence opt5 from neuraminidase__InfluenzaA__AHL90364

SEQ ID NO: 207640 - RNA, 1413 nt, Artificial Sequence; identical to SEQ ID NO: 200485
  derived and/or modified sequence opt5 from neuraminidase__InfluenzaA__AHL90376

SEQ ID NO: 207641 - RNA, 1410 nt, Artificial Sequence
  derived and/or modified sequence opt5 from neuraminidase__InfluenzaA__AHL90388
augaaccccaaucagaagaucauuaccaucggcagcgugucccugauuaucucuacaauuugcuucuuuaugcaaaucgccauccucauuacgaccgucacacugcacuucaaacaguacgaguuuaacagcuccccuaauaaccagguuaugcuuugugaaccgaccaucauugagagaaauaucacagaaauuguguaucugaccaacacaaucauugagaaggaaaucugccccaaacucgcugaguaccggaauuggucuaagccucagugugacaucaccggguucgcccccuuuagcaaagauaacuccauucgccugucugcgggaggcgacaucugggugacgagagagccuuaugucagcugcgaucccgacaaguguuaccaauucgcucuugggcagggaaccacacugaauaacgugcauuccaauaacaccguucgggaucgcacaccuuauagaacccuccugaugaaugaacugggcgugccguuucaccucgggacgaagcaggucugcauugccuggucuagcuccagcugucaugacggaaaagccuggcugcacgugugcaucacaggcgaugacaagaacgcuaccgccucuuucauuuacaauggccggcuuguugauuccaucgugagcuggucuaaagagauccugcgcacacaggaauccgagugugucugcauuaacgggaccuguaccguggugaugacagacggaagcgcuuccggcaaggccgauacgaaaauccucuuuauugaggaagggaagaucguccauaccucuacacugagcggauccgcgcaacacguugaggaaugcagcugcuaucccagauacccuggcgugcggugugugugccgcgacaacuggaaggggucuaauagacccauugucgauaucaacaucaaagaccacuccauugugagcucuuacguuuguagcggacuugugggcgacaccccucggaagaaugauuccucuagcuccagccauugccuggaccccaacaaugaggaaggcgggcacggagucaaaggcugggccuucgaugacgggaacgauguguggaugggacgcacaaucucugagaaguccagacucggcuaugagaccuuuaaaguuauugaaggguggagcaauccgaagucuaaacugcagaucaaccgccaggugauugucgaccggggaaauagauccggcuacagcggcaucuucuccguggaggggaagucuuguauuaaccggugcuuuuaugucgaacugaucagaggacgcaaggaggaaacggaggugcucuggacaagcaauuccaucguuguguucuguggcaccucugggaccuacggaacaggcagcuggccugauggggcugacauuaaccugaugcccaucuga

SEQ ID NO: 207642 - RNA, 1410 nt, Artificial Sequence; identical to SEQ ID NO: 199536
  derived and/or modified sequence opt5 from neuraminidase__InfluenzaA__AHL90400

SEQ ID NO: 207643 - RNA, 1410 nt, Artificial Sequence; identical to SEQ ID NO: 199536
  derived and/or modified sequence opt5 from neuraminidase__InfluenzaA__AHL90413

SEQ ID NO: 207644 - RNA, 1410 nt, Artificial Sequence
  derived and/or modified sequence opt5 from neuraminidase__InfluenzaA__AHL90425
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucacgaccggacaccguaucgcacccuccugaugaacgaacugggcgugcccuuucaucucgggacaaagcaggucugcaucgccugguccucuagcuccugucacgauggaaaagccuggcugcaugugugcauuaccggcgacgauaagaaugcuaccgccagcuucaucuacaacggcagacuuguugacucuauuguguccuggagcaaagagauccugcggacacaggaaucugagugugucugcauuaaugggacguguaccguggugaugacagauggauccgcuagcggcaaggccgacaccaaaauccucuuuaucgaggaagggaagauuguccacacauccacccugucuggaagcgcgcaacacguugaggaaugcuccugcuauccucgcuaccccggcgugagaugugugugccgggauaacuggaaggggagcaaccgcccuaucgucgacauuaauaucaaagaccauucuauuguguccagcuacguuuguucuggacuugugggcgauacgcccagaaagaacgacagcuccucuagcucccacugccuggauccgaauaacgaggaaggcgggcauggagucaaaggcugggccuucgacgaugggaaugacguguggaugggacggacaaucagcgagaagucucgccucggcuaugagaccuuuaaaguuaucgaagggugguccaacccuaagagcaaacugcagauuaauagacaggugaucgucgaucggggagaccgcucuggcuacuccggcauuuucagcguggaggggaaguccuguaucaacagaugcuuuuaugucgaacugauucggggaagaaaggaggaaaccgaggugcucuggacaucuaauagcaucguuguguucuguggcaccuccgggacauacggaacgggcucuuggcccgauggggcugacauuaaccugaugccuaucuga

SEQ ID NO: 207645 - RNA, 1410 nt, Artificial Sequence; identical to SEQ ID NO: 199623
  derived and/or modified sequence opt5 from neuraminidase__InfluenzaA__AHL90437

SEQ ID NO: 207646 - RNA, 1410 nt, Artificial Sequence; identical to SEQ ID NO: 199536
  derived and/or modified sequence opt5 from neuraminidase__InfluenzaA__AHL90449

SEQ ID NO: 207647 - RNA, 1410 nt, Artificial Sequence; identical to SEQ ID NO: 199536
  derived and/or modified sequence opt5 from neuraminidase__InfluenzaA__AHL90461

SEQ ID NO: 207648 - RNA, 1410 nt, Artificial Sequence; identical to SEQ ID NO: 199536
  derived and/or modified sequence opt5 from neuraminidase__InfluenzaA__AHL90473

SEQ ID NO: 207649 - RNA, 1410 nt, Artificial Sequence; identical to SEQ ID NO: 199536
  derived and/or modified sequence opt5 from neuraminidase__InfluenzaA__AHL90485

SEQ ID NO: 207650 - RNA, 1410 nt, Artificial Sequence; identical to SEQ ID NO: 199627
  derived and/or modified sequence opt5 from neuraminidase__InfluenzaA__AHL90497

SEQ ID NO: 207651 - RNA, 1410 nt, Artificial Sequence; identical to SEQ ID NO: 199627
  derived and/or modified sequence opt5 from neuraminidase__InfluenzaA__AHL90509

SEQ ID NO: 207652 - RNA, 1410 nt, Artificial Sequence
  derived and/or modified sequence opt5 from neuraminidase__InfluenzaA__AHL90521
augaaccccaaucagaagaucauuaccaucggcagcgugucccugacaauuucuacgaucugcuucuuucuccaaauugccauccugaucaccacagucacccuucacuucaaacaguacgaguuuaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguucgccccuuuuucuaaagauaacagcauccgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcauugccugguccucuagcuccugucaugacggaaaagccuggcuucacgugugcaucacaggcgaugacaagaacgcuaccgccagcuucauuuacaauggccggcugguugauucuaucguguccuggagcaaagagauucuccgcacccaggaaucugagugugucugcaucaacgggacauguacgguggugaugaccgacggauccgcuagcggcaaggccgauacaaaaauccuguuuauugaggaagggaagaucguccauaccuccacacuuucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuggugggcgacacgccccggaagaaugauagcuccucuagcucccauugccucgacccgaacaaugaggaaggcgggcacggagucaaaggcugggccuucgaugacgggaacgauguguggaugggacgcaccaucagcgagaagucuagacugggcuaugagacauuuaaaguuauugaagggugguccaauccuaagagcaaacugcagaucaaccgccaggugauugucgaccggggaaauagaucuggcuacuccggcaucuucagcguggaggggaaguccuguauuaaccggugcuuuuaugucgaacucaucagaggacgcaaggaggaaaccgaggugcuguggaccucuaauagcauuguuguguucuguggcacauccgggaccuacggaacaggcucuuggcccgauggggcugacaucaaccuuaugccuaucuga

SEQ ID NO: 207653 - RNA, 1410 nt, Artificial Sequence
  derived and/or modified sequence opt5 from neuraminidase__InfluenzaA__AHL90533
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagagauccugcgcacacaggaaucugagugugucugcauuaaugggacguguaccguggugaugacagauggauccgcuagcggcaaggccgacaccaaaauccucuuuaucgaggaagggaagauuguccauacauccacccugucuggaagcgcgcaacacguugaggaaugcuccugcuauccuagauaccccggcgugcggugugugugccgcgauaacuggaaggggagcaacagaccuaucgucgacauuaauaucaaagaccacucuauuguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcacaaucagcgagaagucuagacucggcuaugagaccuuuaaaguuaucgaagggugguccaacccuaagagcaaacugcagauuaaucgccaggugaucgucgagcggggagauagaucuggcuacuccggcauuuucagcguggaagggaaguccuguaucaaccggugcuuuuaugucgagcugauuagaggacgcaaggaagagaccgaggugcucuggacaucuaauagcaucguuguguucuguggcaccuccgggacauacggaacgggcucuuggcccgacggggcugauauuaaccugaugccuaucuga

SEQ ID NO: 207654 - RNA, 1410 nt, Artificial Sequence; identical to SEQ ID NO: 199536
  derived and/or modified sequence opt5 from neuraminidase__InfluenzaA__AHL90545

SEQ ID NO: 207655 - RNA, 1410 nt, Artificial Sequence; identical to SEQ ID NO: 199623
  derived and/or modified sequence opt5 from neuraminidase__InfluenzaA__AHL90557

SEQ ID NO: 207656 - RNA, 1410 nt, Artificial Sequence
  derived and/or modified sequence opt5 from neuraminidase__InfluenzaA__AHL90569
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaaaggguucgccccuuuuucuaaggauaacagcauccgccuguccgcgggaggcgacaucugggugaccagagagcccuaugucucuugcgauccugacaaguguuaccaauucgcucuugggcagggaacaacccugaauaacgugcauagcaauaacacaguucgggaucgcaccccguauagaacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggccggcuuguugauucuguggucuccuggagcaaggagauccugcgcacccaggaaucugagugugugugcauuaacgggaccuguacaguggucaugacggacggauccgcuagcggcaaagccgauaccaagauccucuuuaucgaggaagggaagauuguucauacauccacccugucuggaagcgcgcaacacguggaggaaugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagacguuuaaggugaucgaagggugguccaauccuaaaagcaagcugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcaccuccgggacauacggaaccggcucuuggcccgauggggcugacauuaaccugaugccuaucuga

SEQ ID NO: 207657 - RNA, 1410 nt, Artificial Sequence; identical to SEQ ID NO: 199623
  derived and/or modified sequence opt5 from neuraminidase__InfluenzaA__AHL90581

SEQ ID NO: 207658 - RNA, 1410 nt, Artificial Sequence; identical to SEQ ID NO: 199627
  derived and/or modified sequence opt5 from neuraminidase__InfluenzaA__AHL90593

SEQ ID NO: 207659 - RNA, 1410 nt, Artificial Sequence
  derived and/or modified sequence opt5 from neuraminidase__InfluenzaA__AHL90605
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcuaacauuaaucugaugccuaucuga

SEQ ID NO: 207660 - RNA, 1410 nt, Artificial Sequence; identical to SEQ ID NO: 199623
  derived and/or modified sequence opt5 from neuraminidase__InfluenzaA__AHL90629

SEQ ID NO: 207661 - RNA, 1410 nt, Artificial Sequence; identical to SEQ ID NO: 199623
  derived and/or modified sequence opt5 from neuraminidase__InfluenzaA__AHL90641

SEQ ID NO: 207662 - RNA, 1410 nt, Artificial Sequence; identical to SEQ ID NO: 199536
  derived and/or modified sequence opt5 from neuraminidase__InfluenzaA__AHL90653

SEQ ID NO: 207663 - RNA, 1410 nt, Artificial Sequence; identical to SEQ ID NO: 199623
  derived and/or modified sequence opt5 from neuraminidase__InfluenzaA__AHL90665

SEQ ID NO: 207664 - RNA, 1410 nt, Artificial Sequence
  derived and/or modified sequence opt5 from neuraminidase__InfluenzaA__AHL90677
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggcaaacuuguugauucuauuguguccuggagcaaggagauccugcggacacaggaaucugagugugucugcauuaacgggacguguaccguggugaugacagacggauccgcuagcggcaaagccgauaccaagauccucuuuaucgaggaagggaagauuguccauacauccacccugucuggaagcgcgcaacacguugaggaaugcuccugcuauccucgcuaccccggcgugagaugugugugccgggacaacuggaaagggagcaaucgcccuaucgucgauauuaacaucaaggaccacucuauuguguccagcuacguuuguucuggacuugugggcgacacgccccggaaaaaugauagcuccucuagcucccauugccuggacccgaacaaugaggaaggcgggcacggagucaagggcugggccuucgaugacgggaacgauguguggaugggaagaacaaucagcgagaaaucucgccucggcuaugagaccuuuaagguuaucgaagggugguccaauccuaaaagcaagcugcagauuaacagacaggugaucgucgaccggggaaaucgcucuggcuacuccggcauuuucagcguggaggggaaguccuguaucaacagaugcuuuuaugucgaacugauucggggaagaaaagaggaaaccgaggugcucuggacaucuaauagcaucguuguguucuguggcaccuccgggacauacggaacgggcucuuggcccgauggggcugacauuaaccugaugccuaucuga

SEQ ID NO: 207665 - RNA, 1410 nt, Artificial Sequence; identical to SEQ ID NO: 199623
  derived and/or modified sequence opt5 from neuraminidase__InfluenzaA__AHL90689

SEQ ID NO: 207666 - RNA, 1410 nt, Artificial Sequence
  derived and/or modified sequence opt5 from neuraminidase__InfluenzaA__AHL90701
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgggaucugggugacaagagagcccuaugucucuugcgacccugauaaguguuaccaauucgcucuuggacagggcaccacacugaauaacgugcauagcaauaacaccguucgggaccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagauauccugcgcacccaggagucugaaugugugugcauuaacggaacauguacgguggucaugaccgacggcuccgcuagcgggaaggccgauacaaaaauccucuuuaucgaggagggaaagauuguucauaccuccacacugucuggcagcgcgcaacacguggaagagugcuccugcuauccuagauaccccggggugcggugugucugccgcgacaacuggaagggaagcaauagaccuaucguggauauuaacaucaaagaccacucuauuguuuccagcuacguguguucuggccuugucggcgacacgccccggaagaaugauagcuccucuagcucccauugccuggacccgaacaaugaagaagggggacacggcgugaaagggugggccuucgaugacggaaacgauguuuggaugggccgcaccaucagcgagaagucuagacucggguaugagacauuuaaagugaucgagggaugguccaauccuaagagcaaacugcagauuaaccggcaggucaucguggaccgcggcaauagaucuggcuacuccgggauuuucagcgucgaaggaaaguccuguaucaaccggugcuuuuauguggagcugauuagaggccgcaaggaagagaccgaaguucucuggaccucuaauagcaucguggucuucugugggacauccggaaccuacggcacagggucuuggcccgauggcgcugacauuaaccugaugccuaucuga

SEQ ID NO: 207667 - RNA, 1410 nt, Artificial Sequence; identical to SEQ ID NO: 202328
  derived and/or modified sequence opt5 from neuraminidase__InfluenzaA__AHL90713

SEQ ID NO: 207668 - RNA, 1413 nt, Artificial Sequence; identical to SEQ ID NO: 202961
  derived and/or modified sequence opt5 from neuraminidase__InfluenzaA__AHL90725

SEQ ID NO: 207669 - RNA, 1413 nt, Artificial Sequence; identical to SEQ ID NO: 201954
  derived and/or modified sequence opt5 from neuraminidase__InfluenzaA__AHL90749

SEQ ID NO: 207670 - RNA, 1413 nt, Artificial Sequence; identical to SEQ ID NO: 200485
  derived and/or modified sequence opt5 from neuraminidase__InfluenzaA__AHL90761

SEQ ID NO: 207671 - RNA, 1413 nt, Artificial Sequence
  derived and/or modified sequence opt5 from neuraminidase__InfluenzaA__AHL90773
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucuaugacacuggcgggcaacagcucccuuuguagcauuucugggugggcuaucuacaccaaggauaauuccauucggaucggaagcaaaggcgacguguucgucauucgcgagccuuuuaucucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucuguugccuggagcgcuuccgccugucacgauggcaugggguggcugaccaucggaauuagcggcccugacaacggggcgguggccguccugaaguauaauggaaucauuacaggcaccaucaaaucuuggaagaaacagauucucagaacgcaggaguccgagugcguguguaugaacggcagcugcuuuacaaucaugaccgaugggcccucuaauaaggcugccagcuacaaaaucuucaagauugaaaagggaaaaguuacaaaguccaucgagcugaacgcuccuaauuuuuauuacgaagaguguucuugcuacccggacaccggcauugugaugugugucugccgggauaacuggcaugggagcaaucgccccuggguguccuucaaccagaaucuugacuaucaaaucggauacauuugcagcggcguguuuggggauaacccuagacccgaggaccgggaaggaucuuguaauccugucaccguugauggcgccaacggcgugaaaggguucuccuauaaguacggaaauggcguguggaucgggcgcacaaaaagcaacagacugcggaagggauuugagaugauuugggaccccaauggcuggacgaacaccgacucugauuucuccgucaaacaggacgugguugcgaucacagauuggagcggguauuccggcucuuuugugcagcacccggaacucaccggacuggacugcauccgcccuuguuucugggucgagcuugugagaggccugccccgggaaaacacaaccauuuggacgagcggguccucuaucagcuucugcggaguuaauuccgauacagccaacuggagcuggccugacggcgcugagcuccccuuuaccauugauaaguga

SEQ ID NO: 207672 - RNA, 1413 nt, Artificial Sequence
  derived and/or modified sequence opt5 from neuraminidase__InfluenzaA__AHL90785
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccgugaacggcgccgauggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccagagaaaacauuacaaucuggaccagcggauccucuauuagcuucugcggcgucaauuccgauacggccaacuggagcuggccugacggggcugagcuccccuuuacaaucgauaaguga

SEQ ID NO: 207673 - RNA, 1413 nt, Artificial Sequence
  derived and/or modified sequence opt5 from neuraminidase__InfluenzaA__AHL90797
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaauaaaagaauuaucaccuacgagaacuccacaugggugaaucauaccuaugucaacaucaauaacacaaauguuguggccggagaagacaagaccucugugacacuggcgggcaacagcucccuuuguagcauuucugggugggcuaucuacaccaaagauaauuccauucggaucggaagcaagggcgacgucuucgugauucgcgagccuuuuaucgccugcucucaccuggaauguagaacguucuuucucacccagggcgcccugcuuaacgauaaacauuccaaugggacaguuaaggaccggagcccguaucgcgcucugaugucuugcccccucggagaggccccuucccccuacaacagcaaguucgaauccguggcuuggucugccagcgcgugucacgauggcaugggguggcugaccaucggaauuuccggcccugacaacggggccgucgcugugcugaaauauaauggaaucauuacaggcaccaucaagagcuggaaaaagcaaauucucagaacgcaggagucugagugcguuuguaugaacggcuccugcuuuacaaucaugaccgaugggcccagcgacaaagccgcuucuuacaagaucuucaagauugaaaaaggaaaggugacaaaaagcaucgagcugaaugccccuaacuuucauuaugaagaguguuccugcuacccggauaccggcauugucaugugugugugccgggacaauuggcacgggucuaaccgccccugggugagcuucaaucagaaccuugauuaccagaucggauauauuugcuccggcgucuuuggggacaauccuagacccgaggauggagaaggcagcuguucuccuguuaccguggacggcgcgaacggggugaagggauucuccuacaaauaugacaauggcgucuggaucgggcggacaaagagcaaccgccugagaaaaggauuugaggugauuugggaucccaauggcuggacgaacaccgacucugauuucuccguuaagcaagacguggucgccaucacagauuggagcggguacuccggcucuuuugugcagcacccggaacucaccggacuggacugcauccggccuuguuucuggguugagcuugugcgcggccugcccagagaaaauacaaccauuuggacgagcggguccucuaucagcuucugcggagucaacuccgauacagcuaacuggagcuggccugacggcgccgagcuccccuuuaccauugauaaguga

SEQ ID NO: 207674 - RNA, 1413 nt, Artificial Sequence; identical to SEQ ID NO: 200485
  derived and/or modified sequence opt5 from neuraminidase__InfluenzaA__AHL90809

SEQ ID NO: 207675 - RNA, 1413 nt, Artificial Sequence; identical to SEQ ID NO: 202961
  derived and/or modified sequence opt5 from neuraminidase__InfluenzaA__AHL90821

SEQ ID NO: 207676 - RNA, 1413 nt, Artificial Sequence
  derived and/or modified sequence opt5 from neuraminidase__InfluenzaA__AHL90833
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaaucagcggauuaucaccuacgagaacuccacaugggugaaucauaccuaugucaacaucaauaacacaaauguuguggccggagaagacaagaccucugugacacuggcgggcaacagcucccuuuguagcauuucugggugggcuaucuacaccaaagauaauuccauucgcaucggaagcaagggcgacgucuucgugauuagagagccuuuuaucucuugcucccaccuggaaugucggacguucuuucucacccaaggcgcccugcuuaacgauaaacauagcaaugggacagccaaggaccgcucuccguauagagcucugauguccugcccccucggagaggccccuagccccuacaacuccaaauucgaaucuguugcuuggagcgccuccgcgugucacgauggcaugggguggcugaccaucggaauuagcggcccugacaacggggccguggcuguccugaaguauaauggaaucauuacaggcaccaucaagucuuggaaaaagcagauucuccggacgcaggaguccgagugcguguguaugaacggcagcugcuuuacaaucaugaccgaugggcccucuaauaaagccgcuagcuacaagaucuucaaaauugaaaagggaaagguuacaaaauccaucgagcugaacgccccuaauuuuuauuacgaagaguguucuugcuacccggacaccggcauugugaugugugucugccgcgauaacuggcaugggagcaauagacccuggguguccuucaaccagaaucuugacuaucaaaugggauacaucugcagcggcguguuuggggauaacccucggcccgaggacggagaaggcucuuguaauccugucaccguugauggcgcgaacggggugaagggauucuccuauaaauacggcaaugggguguggauuggacgcacaaagagcaacagacugcggaaaggcuuugagaugaucugggaccccaauggguggacgaacaccgacucugauuucuccgucaagcaggacgugguugccauuacagauuggagcggcuauuccggaucuuuugugcagcacccggaacucaccggccuggacugcauccgcccuuguuucugggucgagcuugugagagggcugccccgggaaaacacaaccaucuggacgagcggauccucuauuagcuucugcggcguuaauuccgauacagcuaacuggagcuggccugacggggccgagcuccccuuuaccaucgauaaauga

SEQ ID NO: 207677 - RNA, 1413 nt, Artificial Sequence; identical to SEQ ID NO: 200485
  derived and/or modified sequence opt5 from neuraminidase__InfluenzaA__AHL90845

SEQ ID NO: 207678 - RNA, 1413 nt, Artificial Sequence; identical to SEQ ID NO: 201954
  derived and/or modified sequence opt5 from neuraminidase__InfluenzaA__AHL90857

SEQ ID NO: 207679 - RNA, 1413 nt, Artificial Sequence; identical to SEQ ID NO: 200485
  derived and/or modified sequence opt5 from neuraminidase__InfluenzaA__AHL90869

SEQ ID NO: 207680 - RNA, 1413 nt, Artificial Sequence
  derived and/or modified sequence opt5 from neuraminidase__InfluenzaA__AHL90881
augaaccccaaucagaagaucauuaccaucggcagcauuuccaucgccauugggaucaucucuacaaugcugcaaauuggaagcaucauuuccaucugggcuucucacagcauucagacgggcucccagaacaauaccgggaucugcaaccagagaauuaucacauacgagaauagcaccugggugaaccauacauaugucaauaucaacaauaccaacguuguggccggagaagacaaaacaagcgugacccucgcgggcaauuccagccuguguucuauuuccgggugggcuaucuacacgaaggauaacagcauucggaucggaucuaaaggcgacgucuucgugauucgcgagccuuuuaucuccugcagccaccuugaauguagaaccuucuuucugacacaaggcgcccuccugaaugauaagcauucuaacgggaccguuaaagaccgguccccguaucgcgcccuuaugagcugcccccugggagaggcuccuucccccuacaauucuaaguucgaaagcguggccugguccgcuagcgccugucacgauggcaugggguggcucacaaucggaauuucuggcccugacaacggggcggucgccgugcugaaguauaacggaaucauuaccggcacgaucaaauccuggaagaaacagauucugagaacacaggagagcgagugcguuuguaugaauggcucuugcuuuaccaucaugacagaugggcccagcaacaaggcugccuccuacaaaaucuucaagauugaaaagggaaaagugaccaagucuaucgagcucaaugcuccuaacuuuuauuacgaagaguguagcugcuacccggacaccggcauugucaugugugugugccgggauaauuggcauggguccaaccgccccugggugagcuucaaucagaaccuggacuaucaaaucggauacauuugcucuggcgucuuuggggauaauccuagacccgaggacggagaaggcuccuguaacccuguuacaguggauggcgccaauggggugaaaggauucagcuauaaguacggcaacggggucuggaucggacggacgaaaucuaaucgccuuauuaagggcuuugagaugaucugggaccccaacggguggaccaauacagacuccgauuucagcgugaaacaggacguuguggcgaucaccgauugguccggcuauucuggaucuuuuguccagcacccggaacugacaggccucgacugcauuagaccuuguuucuggguggagcugguucgggggcuuccccgcgaaaacaccacgaucuggacauccggaucuagcauuuccuucugcggcgugaacagcgauaccgccaauuggucuuggccugacggggcugagcugcccuuuaccaucgauaaguga

SEQ ID NO: 207681 - RNA, 1413 nt, Artificial Sequence; identical to SEQ ID NO: 202961
  derived and/or modified sequence opt5 from neuraminidase__InfluenzaA__AHL90893

SEQ ID NO: 207682 - RNA, 1413 nt, Artificial Sequence; identical to SEQ ID NO: 201954
  derived and/or modified sequence opt5 from neuraminidase__InfluenzaA__AHL90905

SEQ ID NO: 207683 - RNA, 1413 nt, Artificial Sequence
  derived and/or modified sequence opt5 from neuraminidase__InfluenzaA__AHL90917
augaaccccaaucagaagaucauuaccaucggcagcauuuccaucgccauugggaucaucucucugacacuccaaauuggaaacaucauuagcaucugggcuucccacucuauucagacgggcagccagaauaacaccgggaucugcaaucagagaauuaucacauacgagaacuccaccugggugaaucauacauaugugaacaucaauaacaccaauguuguggccggagaagacaaaacaucugugacccuggcgggcaacagcucccuuuguagcauuucugggugggcuaucuacacgaaggauaauuccauucggaucggaagcaaaggcgacgucuucgugauucgcgagccuuuuaucucuugcucccaccuggaauguagaaccuucuuucucacacaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaauuagcggcccugacaacggggcggucgccgugcugaaguauaauggaaucauuaccggcacgaucaaaucuuggaagaaacagauucucagaacacaggaguccgagugcguuuguaugaacggcagcugcuuuaccaucaugacagaugggcccucuaauaaggcugccagcuacaaaaucuucaagauugaaaagggaaaagugaccaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuacaguggauggcgccaacggggugaaaggauucuccuauaaguacggcaauggggucuggaucggacggacgaaaagcaaccgccugagaaagggcuuugagaugauuugggaccccaauggguggaccaacacagacucugauuucuccgugaaacaggacguuguggcgaucaccgauuggagcggcuauuccggaucuuuuguccagcacccggaacucacaggccuggacugcauccggccuuguuucuggguggagcuuguucgcgggcugcccagagaaaacaccacgauuuggacaagcggauccucuaucagcuucugcggcgucaauuccgauaccgccaacuggagcuggccugacggggcugagcuccccuuuaccauugauaaguga

SEQ ID NO: 207684 - RNA, 1413 nt, Artificial Sequence
  derived and/or modified sequence opt5 from neuraminidase__InfluenzaA__AHL90929
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucuaugacacuggcgggcaacagcucccuuuguagcauuucugggugggcuaucuacaccaaggauaauuccauucggaucggaagcaaaggcgacguguucgucauucgcgagccuuuuaucucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucuguugccuggagcgcuuccgccugucacgauggcaugggguggcugaccaucggaauuagcggcccugacaacggggcgguggccguccugaaguauaauggaaucauuacaggcaccaucaaaucuuggaagaaacagauucucagaacgcaggaguccgagugcguguguaugaacggcagcugcuuuacaaucaugaccgaugggcccucuaauaaggcugccagcuacaaaaucuucaagauugaaaagggaaaaguuacaaaguccaucgagcugaacgcuccuaauuuuuauuacgaagaguguucuugcuacccggacaccggcauugugaugugugucugccgggauaacuggcaugggagcaaucgccccuggguguccuucaaccagaaucuugacuaucaaaucggauacauuugcagcggcguguuuggggauaacccuagacccgaggacggagaaggcucuuguaauccugucaccguugauggcgccaacggggugaaaggauucuccuauaaguacggcaaugggguguggaucggacggacaaaaagcaaccgccugagaaagggcuuugagaugauuugggaccccaauggguggacgaacaccgacucugauuucuccgucaaacaggacgugguugcgaucacagauuggagcggcuauuccggaucuuuugugcagcacccggaacucaccggccuggacugcauccggccuuguuucugggucgagcuugugcgcgggcugcccagagaaaacacaaccauuuggacgagcggauccucuaucagcuucugcggcguuaauuccgauacagccaacuggagcuggccugacggggcugagcuccccuuuaccauugauaaguga

SEQ ID NO: 207685 - RNA, 1413 nt, Artificial Sequence; identical to SEQ ID NO: 201954
  derived and/or modified sequence opt5 from neuraminidase__InfluenzaA__AHL90941

SEQ ID NO: 207686 - RNA, 1413 nt, Artificial Sequence; identical to SEQ ID NO: 201954
  derived and/or modified sequence opt5 from neuraminidase__InfluenzaA__AHL90953

SEQ ID NO: 207687 - RNA, 1413 nt, Artificial Sequence; identical to SEQ ID NO: 201954
  derived and/or modified sequence opt5 from neuraminidase__InfluenzaA__AHL90965

SEQ ID NO: 207688 - RNA, 1413 nt, Artificial Sequence
  derived and/or modified sequence opt5 from neuraminidase__InfluenzaA__AHL90977
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucgccgauuggagcggcuauuccggaucuuuuguccagcacccggaacucacaggccuggacugcauccggccuuguuucuggguggagcuuguucgcgggcugcccagagaaaacaccacaauuuggaccagcggauccucuaucagcuucugcggcgucaauuccgauacggcuaacuggagcuggccugacggggccgagcuccccuuuacaauugauaaguga

SEQ ID NO: 207689 - RNA, 1413 nt, Artificial Sequence; identical to SEQ ID NO: 203228
  derived and/or modified sequence opt5 from neuraminidase__InfluenzaA__AHL90989

SEQ ID NO: 207690 - RNA, 1413 nt, Artificial Sequence; identical to SEQ ID NO: 207684
  derived and/or modified sequence opt5 from neuraminidase__InfluenzaA__AHL91001

SEQ ID NO: 207691 - RNA, 1413 nt, Artificial Sequence
  derived and/or modified sequence opt5 from neuraminidase__InfluenzaA__AHL91013
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcucccagagaauuaucaccuacgagaauagcacaugggugaaccauaccuaugucaauaucaacaauacaaacguuguggccggagaagacaaaaccagcaugacacuggcgggcaauuccagccuuuguucuauuuccgggugggcuaucuacaccaaggauaacagcauucggaucggaucuaaaggcgacguguucgucauucgcgagccuuuuaucuccugcagccaccuggaauguagaacguucuuucucacccaaggcgcccugcuuaaugauaagcauucuaacgggacagugaaagaccgguccccguaucgcgcccugaugagcugcccccucggagaggcuccuucccccuacaauucuaaguucgaaagcguugccugguccgcuagcgccugucacgauggcaugggguggcugaccaucggaauuucuggcccugacaacggggcgguggccguccugaaguauaacggaaucauuacaggcaccaucagauccuggaaaaagcagauucuccggacgcaggagagcgagugcguguguaugaauggcucuugcuuuacaaucaugaccgaugggcccagcaacaaagcugccuccuacaagaucuucaaaauugaaaagggaaagguuacaaaaucuaucgagcugaaugcuccuaacuuuuauuacgaagaguguagcugcuacccggacaccggcauugugaugugugucugccgcgauaauuggcauggguccaacagacccugggugagcuucaaucagaaccuugacuaucaaaucggauacauuugcucuggcguguuuggggauaauccucggcccgaggacggagaaggcuccuguaacccugucaccguugauggcgccaauggggugaagggauucagcuauaaauacggcaacgggguguggaucggacgcacaaagucuaauagacugcggaaaggcuuugagaugauuugggaccccaacggguggacgaauaccgacuccgauuucagcgucaagcaggacgugguugcgaucacagauugguccggcuauucuggaucuuuugugcagcacccggaacucaccggccuggacugcauccgcccuuguuucugggucgagcuugugagagggcugccccgggaaaacacaaccauuuggacguccggaucuagcaucuccuucugcggcguuaacagcgauacagccaauuggucuuggccugacggggcugagcuccccuuuaccauugauaaauga

SEQ ID NO: 207692 - RNA, 1413 nt, Artificial Sequence; identical to SEQ ID NO: 207684
  derived and/or modified sequence opt5 from neuraminidase__InfluenzaA__AHL91025

SEQ ID NO: 207693 - RNA, 1410 nt, Artificial Sequence; identical to SEQ ID NO: 200929
  derived and/or modified sequence opt5 from neuraminidase__InfluenzaA__AHL91037

SEQ ID NO: 207694 - RNA, 1410 nt, Artificial Sequence; identical to SEQ ID NO: 202542
  derived and/or modified sequence opt5 from neuraminidase__InfluenzaA__AHL91049

SEQ ID NO: 207695 - RNA, 1410 nt, Artificial Sequence
  derived and/or modified sequence opt5 from neuraminidase__InfluenzaA__AHL91061
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccugaacccgaauaacgaggaaggcgggcacggagugaaaggcugggccuucgacgaugggaaugacguuuggaugggacgcaccaucagcgagaagucuagacucggcuaugagacauuuaaagugaucgaagggugguccaaccauaagagcaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggccugacggggcugaucugaaucuuaugcccauuuga

SEQ ID NO: 207696 - RNA, 1410 nt, Artificial Sequence
  derived and/or modified sequence opt5 from neuraminidase__InfluenzaA__AHL91073
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaccugguccaagccccagugugacauuacaggguucgccccuuuuucuaaagauaauagcauccgccuguccgcgggaggcgacaucugggugaccagagagcccuaugucucuugcgauccugacaaguguuaccaauucgcucuugggcagggaacaacccugaacaaugugcauagcaacaauacgguucgggaucgcacaccguauagaacccuccugaugaacgaacugggcgugcccuuucaccucgggacaaagcaggucugcauugccugguccagcagcuccugucaugacggaaaagccuggcugcacgugugcaucaccggcgaugacaagaaugcuaccgccagcuucauuuacaacggccggcuuguugauucuguggucuccuggagcaaagagauccugcgcacacaggaaucugagugugugugcauuaaugggacguguaccguggucaugacagacggauccgcuagcggcaaggccgauaccaaaauccucuuuaucgaggaagggaagauuguucauacauccacccugucuggaagcgcgcaacacguggaggaaugcuccugcuauccuagauaccccggcgugcggugugucugccgcgacaacuggaaggggagcaacagaccuaucguggauauuaauaucaaagaccacucuauuguuuccagcuacguguguucuggacuugucggcgacacgccccggaagaacgauagcuccucuggcagccauugccuggacccgaauaacgaggaagggggacacggcgugaaagggugggccuucgaugacggaaaugauguuuggaugggccgcacaaucuccgagaagucuagacucggguaugagaccuuuaaagugaucgaaggauggucuaaccauaaguccaaacugcagauuaaucggcaggucaucguggaccgcggcaacagaagcggcuacucugggauuuucuccgucgagggaaagagcuguaucaaucggugcuuuuauguggaacugauuagaggccgcaaggaggaaaccgagguucucuggacauccaacucuaucguggucuucugugggaccagcggaacauacggcacgggguccuggccugauggcgcugaccugaaucuuaugcccauuuga

SEQ ID NO: 207697 - RNA, 1410 nt, Artificial Sequence
  derived and/or modified sequence opt5 from neuraminidase__InfluenzaA__AHL91085
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccaagauuaucgagagaaauauuacagaaaucguguaucugaccaacacaaccauugagaaagaaaucugcccuaagcucgcugaguaccggaauugguccaaaccccagugugacauuacgggguucgccccuuuuucuaaggauaacagcauccgccuguccgcgggaggcgacaucugggugaccagagagcccuaugucucuugcgauccugacaaguguuaccaauucgcucuugggcagggaacaacccugaauaacgugcauagcaauaacacaguucgggaucgcaccccguauagaacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggccggcuuguugauucuguggucuccuggagcaaggagauccugcgcacccaggaaucugagugugugugcauuaacgggaucuguaccguggucaugacagacggauccgcuagcggcaaagccgauacgaagauccucuuuauugaggaagggaagaucguucauaccuccacacugucuggaagcgcgcaacacguggaggaaugcuccugcuauccuagauaccccggcgugcggugugucugccgcgacaacuggaaagggagcaauagaccuauuguggauaucaacauuaaggaccacucuaucguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagaccuuuaaggugauugaagggugguccaauccuaaaagcaagcugcagaucaaccggcaggucauuguggaccgcggaaauagaucuggcuacuccggcaucuucagcgucgaggggaaguccuguauuaaccggugcuuuuauguggaacugaucagaggacgcaaagaggaaacggagguucucuggacaucuaauagcauuguggucuucuguggcaccuccgggaccuacggaacaggcucuuggcccgauggggcugacaucaaccugaugccuaucuga

SEQ ID NO: 207698 - RNA, 1410 nt, Artificial Sequence; identical to SEQ ID NO: 199623
  derived and/or modified sequence opt5 from neuraminidase__InfluenzaA__AHL91097

SEQ ID NO: 207699 - RNA, 1410 nt, Artificial Sequence
  derived and/or modified sequence opt5 from neuraminidase__InfluenzaA__AHL91109
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaaucauaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggccugauggggcugaccugaacauuaugcccaucuga

SEQ ID NO: 207700 - RNA, 1410 nt, Artificial Sequence; identical to SEQ ID NO: 200929
  derived and/or modified sequence opt5 from neuraminidase__InfluenzaA__AHL91121

SEQ ID NO: 207701 - RNA, 1410 nt, Artificial Sequence
  derived and/or modified sequence opt5 from neuraminidase__InfluenzaA__AHL91133
augaaccccaaucagaagaucauuaccaucggcagcgugucccugacaauuucuacgaucugcuucuuuaugcaaauugccauccucaucaccacagucacccugcacuucaaacaguuugaguucaacagcccuccgaauaaccagguuaugcuuugugaacccacaauuaucgagagaaauauuaccgaaaucguguaccugacaaacaccacgauugagaaggaaaucugcccuaaacucgcugaguaucggaauugguccaagccccagugugacauuaccggguuugccccuuucucuaaagauaacagcauccgccuguccgcgggaggcgacaucugggugacaagagagcccuacgucucuugcgauccugacaaguguuaucaauuugcucuugggcagggaaccacacugaauaacgugcauagcaauaacaccguucgggaucgcacgccguacagaacacuccugaugaaugaacugggcgugcccuuccaccucgggaccaagcaggucugcauugccugguccucuagcuccugucaugacggaaaagccuggcugcacgugugcaucacaggcgaugacaagaacgcuaccgccagcuuuauuuauaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuucaucgaggaagggaagauuguucauaccuccacacugucuggaagcgcgcaacacguggaggaaugcuccugcuacccuagauaucccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuuugaugacgggaacgauguuuggaugggacgcaccaucagcgagaagucuagacucggcuacgagacauucaaagugaucgaagggugguccaaucauaagagcaaacugcagauuaaccggcaggucaucguggaccgcggaaauagaucuggcuauuccggcauuuuuagcgucgaggggaaguccuguaucaaccggugcuucuacguggaacugauuagaggacgcaaggaggaaaccgagguucucuggaccucuaauagcaucguggucuucuguggcacauccgggaccuauggaacaggcucuuggccugauggggcugaccugaaccuuaugcccauuuga

SEQ ID NO: 207702 - RNA, 1410 nt, Artificial Sequence; identical to SEQ ID NO: 202328
  derived and/or modified sequence opt5 from neuraminidase__InfluenzaA__AHL91145

SEQ ID NO: 207703 - RNA, 1410 nt, Artificial Sequence; identical to SEQ ID NO: 202328
  derived and/or modified sequence opt5 from neuraminidase__InfluenzaA__AHL91157

SEQ ID NO: 207704 - RNA, 1410 nt, Artificial Sequence; identical to SEQ ID NO: 197736
  derived and/or modified sequence opt5 from neuraminidase__InfluenzaA__AHL91169

SEQ ID NO: 207705 - RNA, 1410 nt, Artificial Sequence; identical to SEQ ID NO: 205170
  derived and/or modified sequence opt5 from neuraminidase__InfluenzaA__AHL94987

SEQ ID NO: 207706 - RNA, 1410 nt, Artificial Sequence; identical to SEQ ID NO: 205170
  derived and/or modified sequence opt5 from neuraminidase__InfluenzaA__AHL94999

SEQ ID NO: 207707 - RNA, 1410 nt, Artificial Sequence
  derived and/or modified sequence opt5 from neuraminidase__InfluenzaA__AHL95011
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguacguguguagcggacuggucggcgacaccccgcgcaagaaugauucuagcuccucuagccauugccuugacccuaacaaugaggaaggcgggcacggagugaaaggcugggccuucgaugacgggaacgauguuuggaugggaagaacgaucaaugagacaucccggcugggcuaugagaccuuuaaggugaucgaagggugguucaaccccaaaagcaagcuccagauuaaucgccaggucaucguggacagaggagaucggucuggcuacuccggcauuuuuagcgucgaggggaaaucuuguaucaacagaugcuucuauguggaacugauucgcggacggaaggaggaaaccgagguucuguggacauccaauagcaucguggucuucuguggcaccuccgggacauacggaacgggcucuuggccugacggggcugaucucaaccugaugcccauuuga

SEQ ID NO: 207708 - RNA, 1410 nt, Artificial Sequence; identical to SEQ ID NO: 206927
  derived and/or modified sequence opt5 from neuraminidase__InfluenzaA__AHL95023

SEQ ID NO: 207709 - RNA, 1410 nt, Artificial Sequence; identical to SEQ ID NO: 205170
  derived and/or modified sequence opt5 from neuraminidase__InfluenzaA__AHL95035

SEQ ID NO: 207710 - RNA, 1410 nt, Artificial Sequence; identical to SEQ ID NO: 205170
  derived and/or modified sequence opt5 from neuraminidase__InfluenzaA__AHL95047

SEQ ID NO: 207711 - RNA, 1410 nt, Artificial Sequence; identical to SEQ ID NO: 206918
  derived and/or modified sequence opt5 from neuraminidase__InfluenzaA__AHL95059

SEQ ID NO: 207712 - RNA, 1410 nt, Artificial Sequence; identical to SEQ ID NO: 205170
  derived and/or modified sequence opt5 from neuraminidase__InfluenzaA__AHL95071

SEQ ID NO: 207713 - RNA, 1410 nt, Artificial Sequence; identical to SEQ ID NO: 205170
  derived and/or modified sequence opt5 from neuraminidase__InfluenzaA__AHL95083

SEQ ID NO: 207714 - RNA, 1410 nt, Artificial Sequence; identical to SEQ ID NO: 205170
  derived and/or modified sequence opt5 from neuraminidase__InfluenzaA__AHL95095

SEQ ID NO: 207715 - RNA, 1410 nt, Artificial Sequence; identical to SEQ ID NO: 205170
  derived and/or modified sequence opt5 from neuraminidase__InfluenzaA__AHL95107

SEQ ID NO: 207716 - RNA, 1410 nt, Artificial Sequence
  derived and/or modified sequence opt5 from neuraminidase__InfluenzaA__AHL95119
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguacguguguagcggacuggucggcgacaccccgcgcaagaaugauucucuuagcuccucucauugccuggacccuaacaaugaggaaggcgggcacggagugaaaggcugggccuucgaugacgggaacgauguuuggaugggaagaacgaucaaugagacaagccggcucggcuaugagaccuuuaaggugaucgaagggugguccaaccccaaaagcaagcugcagauuaaucgccaggucaucguggacagaggagaucggucuggcuacuccggcauuuucagcgucgaggggaaaucuuguaucaacagaugcuuuuauguggaacugauucgcggacggaaggaggaaaccgagguucucuggacauccaauagcaucguggucuucuguggcaccuccgggacauacggaacgggcucuuggccugacggggcugaucugaaccuuaugcccauuuga

SEQ ID NO: 207717 - RNA, 1410 nt, Artificial Sequence; identical to SEQ ID NO: 206399
  derived and/or modified sequence opt5 from neuraminidase__InfluenzaA__AHL95131

SEQ ID NO: 207718 - RNA, 1410 nt, Artificial Sequence; identical to SEQ ID NO: 206907
  derived and/or modified sequence opt5 from neuraminidase__InfluenzaA__AHL95143

SEQ ID NO: 207719 - RNA, 1410 nt, Artificial Sequence
  derived and/or modified sequence opt5 from neuraminidase__InfluenzaA__AHL95155
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggagccacggagugaaaggcugggccuucgacgaugggaacgacguuuggaugggacgcacgaucaaugagacaucuagacugggcuaugagaccuuuaaggugaucgaagggugguccaaccccaaaagcaagcuccagauuaaucggcaggucaucguggaucgcggagacagaucuggcuacuccggcauuuucagcgucgaggggaaauccuguaucaaccggugcuuuuauguggaacugauuagaggacgcaaggaggaaaccgagguucuguggacaucuaauagcaucguggucuucuguggcaccuccgggacauacggaacgggcucuuggccugauggggcugaccucaaccugaugcccauuuga

SEQ ID NO: 207720 - RNA, 1410 nt, Artificial Sequence
  derived and/or modified sequence opt5 from neuraminidase__InfluenzaA__AHL95167
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguaccuguguagcggacuugugggcgacaccccgcgcaagaaugauucuagcuccucuagccauugccuggacccuaacaaugaggaaggcgggcacggagucaaaggcugggccuucgaugacgggaacgauguguggaugggaagaacgaucaaugagacaucccggcucggcuaugagaccuuuaagguuaucgaaggguggagcaaccccaaaucuaagcugcagauuaaucgccaggugaucgucgacagaggagaucgguccggcuacagcggcauuuucucuguggaggggaaauccuguaucaacagaugcuuuuaugucgaacugauucgcggacggaaggaggaaaccgaggugcucuggacaagcaauuccaucguuguguucuguggcaccucugggacauacggaacgggcagcuggccugacggggcugaucugaaccuuaugcccauuuga

SEQ ID NO: 207721 - RNA, 1410 nt, Artificial Sequence; identical to SEQ ID NO: 205170
  derived and/or modified sequence opt5 from neuraminidase__InfluenzaA__AHL95179

SEQ ID NO: 207722 - RNA, 1410 nt, Artificial Sequence; identical to SEQ ID NO: 205170
  derived and/or modified sequence opt5 from neuraminidase__InfluenzaA__AHL95191

SEQ ID NO: 207723 - RNA, 1410 nt, Artificial Sequence; identical to SEQ ID NO: 205170
  derived and/or modified sequence opt5 from neuraminidase__InfluenzaA__AHL95203

SEQ ID NO: 207724 - RNA, 1410 nt, Artificial Sequence; identical to SEQ ID NO: 205170
  derived and/or modified sequence opt5 from neuraminidase__InfluenzaA__AHL95215

SEQ ID NO: 207725 - RNA, 1410 nt, Artificial Sequence
  derived and/or modified sequence opt5 from neuraminidase__InfluenzaA__AHL95227
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcgggagaaugacagcuccucuagcucccauugccuugauccuaacaaugaagaagggggacacggcgucaaggggugggccuucgacgauggaaacgacguguggaugggccgcacgaucaaugagacaagcagacugggguaugagaccuuuaaaguuaucgagggauggucuaaccccaaguccaaacuccagauuaaucgccaggugaucgucgaucggggcgacagaagcggcuacucugggauuuucuccguggaaggaaagagcuguaucaaccggugcuuuuaugucgagcugauuagaggccgcaaagaagagaccgaggugcuguggacauccaauucuaucguuguguucugugggaccagcggaacauacggcacgggguccuggccugauggcgcugaccucaaccugaugcccauuuga

SEQ ID NO: 207726 - RNA, 1410 nt, Artificial Sequence; identical to SEQ ID NO: 206907
  derived and/or modified sequence opt5 from neuraminidase__InfluenzaA__AHL95239

SEQ ID NO: 207727 - RNA, 1410 nt, Artificial Sequence
  derived and/or modified sequence opt5 from neuraminidase__InfluenzaA__AHL95251
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucaaggagggaaagauuguucauaccuccacacucucuggcagcgcgcaacacguggaagagugcuccugcuaucccagauacccuggggugcggugugucugccgcgauaacuggaaaggaagcaauagacccaucguggacauuaacaucaaggaucacucuauuguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacgaucaaugagacaagcagacugggguaugagaccuuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaggaagagaccgaaguucuguggacauccaauucuaucguggucuucugugggaccagcggaacauacggcacgggguccuggccugauggcgcugaccucaaccugaugcccauuuga

SEQ ID NO: 207728 - RNA, 1410 nt, Artificial Sequence; identical to SEQ ID NO: 205170
  derived and/or modified sequence opt5 from neuraminidase__InfluenzaA__AHL95263

SEQ ID NO: 207729 - RNA, 1410 nt, Artificial Sequence
  derived and/or modified sequence opt5 from neuraminidase__InfluenzaA__AHL95275
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacauuaccaucgagaaggaaauuugcccuaaacccgcugaguaccggaauugguccaagccucagugugggaucacgggauucgcccccuuuucuaaagacaacagcauccgccucuccgcgggcggggauauuugggugaccagagagccuuaugucucuugcgacccggauaaguguuaccaauucgcucugggacagggcacaacccuuaauaacgugcauagcaauaacacaguucgggaccgcacccccuauagaacgcugcucaugaaugaacugggggugccuuuucaccugggaacaaagcaggucugcaucgccugguccucuagcuccugucaugauggcaaagccuggcuccacgugugcauuaccggcgacgauaagaacgcuacagccagcuucaucuacaaugggcggcugguugacucuguggucuccuggagcaaagagauucuucgcacccaggaaucugagugugugugcaucaacggaaccuguacaguggucaugacggauggcuccgcuagcgggaaggccgacaccaaaauccuguuuauugaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacaccgcggaagaaugacagcuccucuagcucccauugccuugauccuaacaaugaggaagggggacacggcgugaaagggugggccuucgacgauggaaacgacguuuggaugggccgcaccaucaaugagacgagcagacugggguaugagacauuuaaggugauugaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggaccuccaauucuauuguggucuucugugggacaagcggaaccuacggcacaggguccuggccugauggcgcugaccucaaccugaugcccaucuga

SEQ ID NO: 207730 - RNA, 1410 nt, Artificial Sequence; identical to SEQ ID NO: 206413
  derived and/or modified sequence opt5 from neuraminidase__InfluenzaA__AHL95299

SEQ ID NO: 207731 - RNA, 1410 nt, Artificial Sequence
  derived and/or modified sequence opt5 from neuraminidase__InfluenzaA__AHL95310
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguacguguguagcggacuggucggcgacaccccgcgcaagaaugauucuagcuccucuagccauugccuugacccuaacaaugaggaaggcgggcacggagugaaaggcugggccuucgaugacgggaacgauguuuggaugggaagaacgaucaaugagacaucccggcugggcuaugagaccuuuaaggugaucgaaggguggagcaaccccaaaucuaagcuccagauuaaucgccaggucaucguggacagaggagaucgguccggcuacagcggcauuuucucugucgaggggaaauccuguaucaacagaugcuuuuauguggaacugauucgcggacggaaggaggaaaccgagguucuguggacaagcaauuccaucguggucuucuguggcaccucugggacauacggaacgggcagcuggccugacggggcuaaccucaaucugaugcccauuuga

SEQ ID NO: 207732 - RNA, 1410 nt, Artificial Sequence; identical to SEQ ID NO: 206918
  derived and/or modified sequence opt5 from neuraminidase__InfluenzaA__AHL95322

SEQ ID NO: 207733 - RNA, 1410 nt, Artificial Sequence; identical to SEQ ID NO: 206895
  derived and/or modified sequence opt5 from neuraminidase__InfluenzaA__AHL95334

SEQ ID NO: 207734 - RNA, 1410 nt, Artificial Sequence; identical to SEQ ID NO: 205170
  derived and/or modified sequence opt5 from neuraminidase__InfluenzaA__AHL95423

SEQ ID NO: 207735 - RNA, 1410 nt, Artificial Sequence; identical to SEQ ID NO: 206918
  derived and/or modified sequence opt5 from neuraminidase__InfluenzaA__AHL95435

SEQ ID NO: 207736 - RNA, 1410 nt, Artificial Sequence; identical to SEQ ID NO: 206895
  derived and/or modified sequence opt5 from neuraminidase__InfluenzaA__AHL95447

SEQ ID NO: 207737 - RNA, 1410 nt, Artificial Sequence
  derived and/or modified sequence opt5 from neuraminidase__InfluenzaA__AHL95461
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaaccugcugaguaccggaauuggagcaagccccagugugggauuaccggauucgccccuuuuuccaaagacaacucuauccgccucagcgcgggcggggauaucugggugacaagagagccguaugucuccugcggacccgacaaguguuaccaauucgcucugggccaggggaccacacuuaauaacaugcauucuaauaacaccgugcgggaucgcacgccuuauagaacacugcucaugaaugaacugggaguucccuuucaccugggcaccaaacaggugugcauugccuggagcuccagcucuugucaugacggcaaggccuggcuccacgucugcaucacaggggaugacaagaacgcuaccgccuccuucauuuacaauggacggcugguggauagcguugugucuugguccaaagagauccuucgcacccaggaaagcgagugugucugcauuaacggcacauguacgguggugaugaccgacgggucugcuuccggaaaggccgauacaaaaauccuguuuaucgaggaaggcaagauuguccauaccagcacacucuccgggucugcgcaacacguugaggaaugcagcugcuauccuagauaccccggagugcggugugugugccgcgacaacuggaagggcuccaauagaccgaucgucgauauuaacaucaaagaccacagcauugugucuuccuacguuuguagcggccuggugggggauaccccucggaagaaugacucuagcuccucuagccauugccuugaccccaacaaugaggaaggaggccacggggucaaaggaugggccuucgaugacggcaacgauguguggauggggcgcacgaucaaugagacauccagacugggauaugagaccuuuaagguuaucgaaggcuggagcaacccuaaaucuaagcuccagauuaaucgccaggugaucgucgaccggggcgauagauccggguacagcggaauuuucucuguggagggcaaauccuguaucaaccggugcuuuuaugucgaacugauuagagggcgcaaggaggaaaccgaggugcuguggacaagcaauuccaucguuguguucuguggaaccucuggcacauacgggacgggcagcuggcccgacggagcugaucucaaccugaugcccauuuga

SEQ ID NO: 207738 - RNA, 1410 nt, Artificial Sequence; identical to SEQ ID NO: 205946
  derived and/or modified sequence opt5 from neuraminidase__InfluenzaA__AHL95473

SEQ ID NO: 207739 - RNA, 1410 nt, Artificial Sequence; identical to SEQ ID NO: 205170
  derived and/or modified sequence opt5 from neuraminidase__InfluenzaA__AHL95485

SEQ ID NO: 207740 - RNA, 1410 nt, Artificial Sequence; identical to SEQ ID NO: 205170
  derived and/or modified sequence opt5 from neuraminidase__InfluenzaA__AHL95497

SEQ ID NO: 207741 - RNA, 1410 nt, Artificial Sequence
  derived and/or modified sequence opt5 from neuraminidase__InfluenzaA__AHL95509
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaaaaucacucuauuguuuccagcuacguguguucuggccuggucggcgauaccccgcggaagaacgacagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 207742 - RNA, 1410 nt, Artificial Sequence; identical to SEQ ID NO: 205170
  derived and/or modified sequence opt5 from neuraminidase__InfluenzaA__AHL95521

SEQ ID NO: 207743 - RNA, 1410 nt, Artificial Sequence; identical to SEQ ID NO: 205170
  derived and/or modified sequence opt5 from neuraminidase__InfluenzaA__AHL95533

SEQ ID NO: 207744 - RNA, 1410 nt, Artificial Sequence; identical to SEQ ID NO: 205170
  derived and/or modified sequence opt5 from neuraminidase__InfluenzaA__AHL95545

SEQ ID NO: 207745 - RNA, 1410 nt, Artificial Sequence
  derived and/or modified sequence opt5 from neuraminidase__InfluenzaA__AHL95557
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauccgccucuccgcgggcggggauauuugggugacaagagagccuuaugucucuugcgacccggauaaguguuaccaauucgcucugggacagggcaccacacuuaauaacgugcauagcaauaacaccgcccgggaccgcacgcccuauagaacacugcucaugaaugaacuggggguuccuuuucaccugggaaccaaacaggugugcaucgccugguccucuagcuccugucaugauggcaaggcuuggcuccacgucugcauuacaggcgacgauaagaacgccaccgcuagcuucaucuacaaugggcggcugguggacucuguuguguccuggagcaaagagauucuucgcacccaggaaucugagugugucugcaucaacggaacauguacgguggugaugaccgauggcuccgccagcgggaaggcggacacaaaaauccuguuuauugaggaaggaaagaucguccauaccuccacacucucuggcagcgcccaacacguugaggaaugcuccugcuaucccagauacccuggggugcggugugugugccgcgauaacuggaagggaagcaauagacccauugucgacaucaacauuaaagaucacucuaucguguccagcuacguuuguucuggccuggugggcgacaccccgcggaagaaugacagcuccucuagcucccauugccuugauccuaacaaugaggaagggggacacggcgucaaagggugggcuuucgacgauggaaacgacguguggaugggccgcacgaucaaugagacaagcagacugggguaugagaccuuuaagguuauugaaggauggucuaaccccgaguccaaacuccagaucaaucgccaggugauugucgaucggggcgacagaagcggcuacucugggaucuucuccguggaaggaaagagcuguauuaaccggugcuuuuaugucgagcugaucagaggccgcaaagaagagaccgaggugcuguggacauccaauucuauuguuguguucugugggaccagcggaacauacggcacgggguccuggccugauggcgccgaccucaaccugaugcccaucuga

SEQ ID NO: 207746 - RNA, 1410 nt, Artificial Sequence; identical to SEQ ID NO: 206895
  derived and/or modified sequence opt5 from neuraminidase__InfluenzaA__AHL95569

SEQ ID NO: 207747 - RNA, 1410 nt, Artificial Sequence; identical to SEQ ID NO: 205170
  derived and/or modified sequence opt5 from neuraminidase__InfluenzaA__AHL95581

SEQ ID NO: 207748 - RNA, 1410 nt, Artificial Sequence
  derived and/or modified sequence opt5 from neuraminidase__InfluenzaA__AHL95605
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacaucagcuccucuagccauugccuugauccuaacaaugaggaagggggacacggcgugaaagggugggccuucgacgauggaaacgacguuuggaugggccgcacgaucaaugagacauccagacugggguaugagaccuuuaaggugauugaaggauggagcaaccccaaaucuaagcuccagaucaaucggcaggucauuguggaucgcggcgacagauccggcuacagcgggaucuucucugucgagggaaaauccuguauuaaccggugcuuuuauguggaacugaucagaggccgcaaggaggaaaccgagguucuguggacaagcaauuccauuguggucuucugugggaccucuggaacauacggcacggggagcuggccugauggcgcugaccucaaccugaugcccaucuga

SEQ ID NO: 207749 - RNA, 1410 nt, Artificial Sequence; identical to SEQ ID NO: 205170
  derived and/or modified sequence opt5 from neuraminidase__InfluenzaA__AHL95617

SEQ ID NO: 207750 - RNA, 1410 nt, Artificial Sequence; identical to SEQ ID NO: 205170
  derived and/or modified sequence opt5 from neuraminidase__InfluenzaA__AHL95629

SEQ ID NO: 207751 - RNA, 1410 nt, Artificial Sequence; identical to SEQ ID NO: 205170
  derived and/or modified sequence opt5 from neuraminidase__InfluenzaA__AHL95641

SEQ ID NO: 207752 - RNA, 1410 nt, Artificial Sequence; identical to SEQ ID NO: 205170
  derived and/or modified sequence opt5 from neuraminidase__InfluenzaA__AHL95653

SEQ ID NO: 207753 - RNA, 1410 nt, Artificial Sequence; identical to SEQ ID NO: 207748
  derived and/or modified sequence opt5 from neuraminidase__InfluenzaA__AHL95665

SEQ ID NO: 207754 - RNA, 1410 nt, Artificial Sequence; identical to SEQ ID NO: 205170
  derived and/or modified sequence opt5 from neuraminidase__InfluenzaA__AHL95677

SEQ ID NO: 207755 - RNA, 1410 nt, Artificial Sequence
  derived and/or modified sequence opt5 from neuraminidase__InfluenzaA__AHL95689
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcuaaucucaaccugaugcccauuuga

SEQ ID NO: 207756 - RNA, 1410 nt, Artificial Sequence; identical to SEQ ID NO: 205170
  derived and/or modified sequence opt5 from neuraminidase__InfluenzaA__AHL95701

SEQ ID NO: 207757 - RNA, 1410 nt, Artificial Sequence; identical to SEQ ID NO: 205170
  derived and/or modified sequence opt5 from neuraminidase__InfluenzaA__AHL95713

SEQ ID NO: 207758 - RNA, 1410 nt, Artificial Sequence
  derived and/or modified sequence opt5 from neuraminidase__InfluenzaA__AHL95725
augaaccccaaucagaagaucauuaccaucggcagcgugucccugacaauuucuacgaucugcuucuuuaugcaaauugccauccucaucaccacagucacccugcacuucaaacaguacgaguuugacccuccgcccaacaaucagguuaugcuuugugaaccuacaauuaucgagagaaacauuaccgaaaucguguaucugacaaauaccacgauugagaaggaaaucugccccaaaccugcugaguaccggaacuggagcaagccccagugugggauuaccggauucgccccuuuuuccaaagauaauucuauccgccucagcgcgggcggggacaucugggugacaagagagccguaugucuccugcgaucccgacaaguguuaccaauucgcucugggacagggcaccacacuuaacaaugugcauucuaacaauaccguucgggaucgcacgccuuauagaacacugcucaugaacgaacugggggugcccuuucaccugggaaccaagcaggucugcauugccuggagcuccagcucuugucaugacggcaaagccuggcuccacgugugcaucacaggcgaugacaagaaugcuaccgccuccuucauuuacaacgggcggcugguugauagcguggucucuugguccaaagagauccuucgcacccaggaaagcgagugugugugcauuaauggaacauguacgguggucaugaccgacggcucugcuuccgggaaggccgauacaaaaauccuguuuaucgaggaaggaaagauuguucauaccagcacacucuccggcucugcgcaacacguggaggaaugcagcugcuauccuagauaccccggggugcggugugucugccgcgacaacuggaagggauccaacagaccgaucguggauauuaauaucaaagaccacagcauuguuucuuccuacguguguagcggccuggucggcgacaccccucggaagaacgauucuagcuccucuagccauugccuugaccccaauaacgaggaagggggacacggcgugaaagggugggccuucgaugacggaaaugauguuuggaugggccgcacgaucaacgagacauccagacugggguaugagaccuuuaaggugaucgaaggauggagcaauccuaaaucuaagcuccagauuaaccggcaggucaucguggaccgcggcgauagauccggcuacagcgggauuuucucugucgagggaaaauccuguaucaaucggugcuuuuauguggaacugauuagaggccgcaaggaggaaaucgagguucuguggaccagcaacuccauuguggucuucugugggacaucuggaaccuacggcacagggagcuggcccgacggcgcugaucucaaucugaugcccaucuga

SEQ ID NO: 207759 - RNA, 1410 nt, Artificial Sequence; identical to SEQ ID NO: 206907
  derived and/or modified sequence opt5 from neuraminidase__InfluenzaA__AHL95737

SEQ ID NO: 207760 - RNA, 1410 nt, Artificial Sequence
  derived and/or modified sequence opt5 from neuraminidase__InfluenzaA__AHL95749
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccgcccgggaccgcacgcccuauagaacacugcucaugaaugaacuggggguuccuuuucaccugggaaccaaacaggugugcauugccugguccucuagcuccugucaugauggcaaggcuuggcuccacgucugcaucacaggcgacgauaagaacgccaccgcuagcuucauuuacaaugggcggcugguggacucuguuguguccuggagcaaagagauccuucgcacccaggaaucugagugugucugcauuaacggaacauguacgguggugaugaccgauggcuccgccagcgggaaggcggacacaaaaauccuguuuaucgaggaaggaaagauuguccauaccuccacacucucuggcagcgcccaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggcuuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuaucguuguguucugugggaccagcggaacauacggcacgggguccuggccugauggcgccgaccucaaccugaugcccauuuga

SEQ ID NO: 207761 - RNA, 1410 nt, Artificial Sequence; identical to SEQ ID NO: 205170
  derived and/or modified sequence opt5 from neuraminidase__InfluenzaA__AHL95761

SEQ ID NO: 207762 - RNA, 1410 nt, Artificial Sequence; identical to SEQ ID NO: 205170
  derived and/or modified sequence opt5 from neuraminidase__InfluenzaA__AHL95773

SEQ ID NO: 207763 - RNA, 1410 nt, Artificial Sequence
  derived and/or modified sequence opt5 from neuraminidase__InfluenzaA__AHL95785
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcgugcgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcaucgccugguccucuagcuccugucaugacggaaaggccuggcuccacguuugcauuacaggcgaugacaagaacgcuaccgccagcuucaucuacaauggccggcugguggauucugucguguccuggagcaaagagauucuucgcacccaggaaucugagugugugugcaucaacgggacauguacggucguuaugaccgacggauccgcuagcggcaaggccgauacaaaaauucuguuuaucgaggaagggaagaucgugcauaccuccacacucucuggaagcgcgcaacacguggaggaaugcuccugcuaucccagauacccuggcguccggugugugugccgcgacaacuggaaggggagcaauagacccauuguugauaucaacauuaaagaccacucuaucguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgauuaaugagacaagcagacugggcuaugagaccuuuaaggucaucgaaggguggucuaaccccaaauccaagcuccagaucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggccugacggggcugaucucaaccugaugcccaucuga

SEQ ID NO: 207764 - RNA, 1410 nt, Artificial Sequence; identical to SEQ ID NO: 206895
  derived and/or modified sequence opt5 from neuraminidase__InfluenzaA__AHL95797

SEQ ID NO: 207765 - RNA, 1410 nt, Artificial Sequence; identical to SEQ ID NO: 205170
  derived and/or modified sequence opt5 from neuraminidase__InfluenzaA__AHL95833

SEQ ID NO: 207766 - RNA, 1410 nt, Artificial Sequence; identical to SEQ ID NO: 206895
  derived and/or modified sequence opt5 from neuraminidase__InfluenzaA__AHL95845

SEQ ID NO: 207767 - RNA, 1410 nt, Artificial Sequence
  derived and/or modified sequence opt5 from neuraminidase__InfluenzaA__AHL95857
augaaccccaaucagaagaucauuagcaucggcuccgugucucugaccauuagcacaaucugcuucuuuaugcaaauugccauccucaucacgaccgucacacugcacuucaaacaguacgaguuuaacuccccuccgaauaaccagguuaugcuuugugaacccaccauuaucgagagaaauauuacagaaaucguguaucugaccaacacaaccauugagaaggaaaucugcccuaaacccgcugaguaccggaauuggucuaagccucagugugggauuacgggauucgcccccuuuagcaaagacaacuccauccgccucucugcgggcggggauaucugggugaccagagagccuuaugucagcugcgacccggauaaguguuaccaauucgcucugggacagggcacaacccuuaauaacgugcauuccaauaacacaguucgggaccgcacccccuauagaacgcugcucaugaaugaacugggggugccuuuucaccugggaacaaagcaggucugcauugccuggucuagcuccagcugucaugauggcaaagccuggcuccacgugugcaucaccggcgacgauaagaacgcuacagccucuuucauuuacaaugggcggcugguugacuccguggucagcuggucuaaagagauccuucgcacccaggaauccgagugugugugcauuaacggaaccuguacaguggucaugacggauggcagcgcuuccgggaaggccgacaccaaaauccuguuuaucgaggaaggaaagauuguucauacaucuacccucagcggcuccgcgcaacacguggaggaaugcagcugcuaucccagauacccuggggugcggugugucugccgcgauaacuggaagggaucuaauagacccaucguggacauuaacaucaaagaucacuccauuguuagcucuuacguguguagcggccuggucggcgacacaccgcggaagaaugacuccucuagcuccagccauugccuugauccuaacaaugaggaagggggacacggcgugaaagggugggccuucgacgauggaaacgacguuuggaugggccgcaccaucaaugagacgucuagacugggguaugagacauuuaaggugaucgaaggaugguccaaccccaaaagcaagcuccagauuaaucggcaggucaucguggaucgcggcgacagaucuggcuacuccgggauuuucagcgucgagggaaaauccuguaucaaccggugcuuuuauguggaacugauuagaggccgcaaggaggaaaccgagguucuguggaccucuaauagcaucguggucuucugugggacauccggaaccuacggcacagggucuuggccugauggcgcugaccucaaccugaugcccauuuga

SEQ ID NO: 207768 - RNA, 1410 nt, Artificial Sequence; identical to SEQ ID NO: 205170
  derived and/or modified sequence opt5 from neuraminidase__InfluenzaA__AHL95869

SEQ ID NO: 207769 - RNA, 1410 nt, Artificial Sequence
  derived and/or modified sequence opt5 from neuraminidase__InfluenzaA__AHL95881
augaaccccaaucagaagaucauuaccaucggcagcgugugcaugacaauugggauggccaaccugauccuccaaauuggaaauaucaucuccauuuggaucucucacagcauucaggucggcaaccagucccagaucgagacguguaaucaaucuguuauuaccuacgaaaacaauacaugggugaaccagaccuaugugaauaucagcaacacaaaucuggcugccgggcaguccgucgugucuguuaaacuugcgggaaacagcucccugugcccugugagcggcugggcuauuuacucuaaggacaauuccgucagaaucgggagcaaaggagauguguucguuauccgggagccguuuauuucuuguagcccccucgaaugccgcaccuucuuucugacacagggcgcccuucugaacgacaagcauuccaauggcaccaucaaagauagaucuccuuaucggacgcucauguccugucccauuggggaggugccuagccccuacaacucccgcuucgaaucugucgccuggagcgcuuccgccugccacgacggaaucaacuggcugaccauuggcaucagcgggccugauucuggagcuguggccgugcugaaguauaauggcaucauuacagacaccaucaaguccuggagaaacaauauucuccggacacaagagagcgagugugcgugcgucaacgggucuuguuuuaccaucaugacggauggaccgagcgacggccaggccuccuacaaaauuuuccgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuuuaaucagaaccuggaauaucagaucggauacauuuguagcggcaucuucggggauaauccucgccccaacgacaaaaccggaucuugcggcccgguguccagcaauggggccaacggaguuaagggcuuuuccuucaaguauggcaaugggguguggauuggaagaacaaaaucuaucagcucccggaagggcuuugagaugauuugggauccuaacggguggaccggaaccgacaacaauuucucuaucaaacaagacaucgucggcauuaacgaauggagcggguacuccggcagcuuugugcagcaucccgagcuuacaggacuggauuguauccgcccuugcuucuggguugaacucauuagaggccggcccaaggagaauacgaucuggaccucuggguccagcauuucuuucuguggagugaacuccgacacagucggcuggagcuggcccgauggggcugagcugccuuuuaccaucgacaaauga

SEQ ID NO: 207770 - RNA, 1410 nt, Artificial Sequence
  derived and/or modified sequence opt5 from neuraminidase__InfluenzaA__AHL95892
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuucccgguacguguguagcggccuggucggcgacaccccgcgcaagaaugacucuagcuccucuagccauugccuugauccuaacaaugaggaagggggacacggcgugaaagggugggccuucgacgauggaaacgacguuuggaugggcagaacgaucaaugagacaucccggcugggguaugagaccuuuaaggugaucgaaggauggagcaaccccaaaucuaagcuccagauuaaucgccaggucaucguggauagaggcgaccgguccggcuacagcgggauuuucucugucgagggaaaauccuguaucaacagaugcuuuuauguggaacugauucgcggccggaaggaggaaaccgagguucuguggacaagcaauuccaucguggucuucugugggaccucuggaacauacggcacggggagcuggccugauggcgcugaccucaaccugaugcccauuuga

SEQ ID NO: 207771 - RNA, 1410 nt, Artificial Sequence; identical to SEQ ID NO: 205170
  derived and/or modified sequence opt5 from neuraminidase__InfluenzaA__AHL95904

SEQ ID NO: 207772 - RNA, 1410 nt, Artificial Sequence
  derived and/or modified sequence opt5 from neuraminidase__InfluenzaA__AHL95916
augaaccccaaucagaagaucauuaccaucggcagcgugucccugacaauuucuacgaucugcuucuuuaugcaaauugccauccucaucaccacagucacccugcacuucaaacaguacgagcuuaacagcccuccgaauaaccagguuaugcugugugaacccacaauuaucgagagaaauauuaccgaaaucguguaucucacaaacaccacgauugagaaggaaaucugcccuaaacccgcugaguaccggaauugguccaagccucagugugggauuaccggauuugcccccuucucuaaagacaacagcauccgccuguccgcgggcggggauaucugggugacaagagagccuuaugucucuugcgacccggauaaguguuaccaauuugcucuuggacagggcaccacacugaauaacgugcauagcaauaacaccguucgggaccgcacgcccuauagaacacuccugaugaaugaacugggggugccuuuccaccucggaaccaagcaggucugcauugccugguccuccucuuccugucaugauggcaaagccuggcugcacgugugcaucacaggcgacgauaagaacgcuaccgccagcuuuauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuucaucgaggaaggaaagauuguucauaccuccacacugucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuugucggcgacaccccgcggaagaaugacagcuccucuagcucccauugccuggauccuaacaaugaggaagggggacacggcgugaaagggugggccuuugacgauggaaacgacguuuggaugggccgcacgaucaaugagacaagcagacucggguaugagaccuucaaggugaucgaaggauggucuaaccccaaauccaagcugcagauuaaucggcaggucaucguggaucgcggcgacagaagcggcuacucugggauuuuuagcgucgagggaaaaagcuguaucaaccggugcuucuauguggaacugauuagaggccgcaaggaggaaaccgagguucucuggacauccaauucuaucguggucuuuugugggaccagcggaacauacggcacgggguccuggccugauggcgcugaccugaaccuuaugcccauuuga

SEQ ID NO: 207773 - RNA, 1410 nt, Artificial Sequence; identical to SEQ ID NO: 206907
  derived and/or modified sequence opt5 from neuraminidase__InfluenzaA__AHL95928

SEQ ID NO: 207774 - RNA, 1410 nt, Artificial Sequence; identical to SEQ ID NO: 206895
  derived and/or modified sequence opt5 from neuraminidase__InfluenzaA__AHL95940

SEQ ID NO: 207775 - RNA, 1410 nt, Artificial Sequence; identical to SEQ ID NO: 205170
  derived and/or modified sequence opt5 from neuraminidase__InfluenzaA__AHL95952

SEQ ID NO: 207776 - RNA, 1410 nt, Artificial Sequence; identical to SEQ ID NO: 205170
  derived and/or modified sequence opt5 from neuraminidase__InfluenzaA__AHL95964

SEQ ID NO: 207777 - RNA, 1410 nt, Artificial Sequence; identical to SEQ ID NO: 205170
  derived and/or modified sequence opt5 from neuraminidase__InfluenzaA__AHL95976

SEQ ID NO: 207778 - RNA, 1410 nt, Artificial Sequence; identical to SEQ ID NO: 205170
  derived and/or modified sequence opt5 from neuraminidase__InfluenzaA__AHL95988

SEQ ID NO: 207779 - RNA, 1410 nt, Artificial Sequence; identical to SEQ ID NO: 205170
  derived and/or modified sequence opt5 from neuraminidase__InfluenzaA__AHL96000

SEQ ID NO: 207780 - RNA, 1410 nt, Artificial Sequence
  derived and/or modified sequence opt5 from neuraminidase__InfluenzaA__AHL96012
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagucccuuaugugucuugcgacccggauaaguguuaccaauucgcucugggacagggcaccacacuuaauaacguucauagcaauaacaccgugcgggaccgcacgcccuauagaacacugcucaugaaugagcugggggucccuuuucaccugggaaccaaacaggugugcauugccugguccucuagcuccugucaugauggcaaggccuggcuccacguuugcaucacaggcgacgauaagaacgcuaccgccagcuucauuuacaaugggcggcugguggacucugucguguccuggagcaaagaaauccuucgcacccaggagucugaaugugugugcauuaacggaacauguacggucguuaugaccgauggcuccgcuagcgggaaggccgacacaaaaauccuguuuaucgaggagggaaagauugugcauaccuccacacucucuggcagcgcgcaacacguggaagagugcuccugcuaucccagauacccugggguccggugugugugccgcgauaacuggaagggaagcaauagacccaucguugacauuaacaucaaagaucacucuauuguguccagcuacgucuguucuggccuggugggcgacaccccgcggaagaaugacagcuccucuagcucccauugccuugauccuaacaaugaagaagggggacacggcguuaaagggugggccuucgacgauggaaacgacguguggaugggccgcacgaucaaugagacaagcagacugggguaugagaccuuuaaggucaucgagggauggucuaaccccaaauccaagcuccagauuaaucgccaggugaucgucgaucggggcgacagaagcggcuacucugggauuuucuccguggaaggaaaaagcuguaucaaccggugcuuuuauguugagcugauuagaggccgcaaggaagagaccgaagugcuguggacauccaauucuaucgucguguucugugggaccagcggaacauacggcacgggguccuggccugauggcgcugaccucaaccugaugcccauuuga

SEQ ID NO: 207781 - RNA, 1410 nt, Artificial Sequence
  derived and/or modified sequence opt5 from neuraminidase__InfluenzaA__AHL96024
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagaaccuucgcacccaggaaucugagugugugugcaucaacggaacauguacgguggucaugaccgauggcuccgcuagcgggaaggccgacacaaaaauucuguuuaucgaggaaggaaagaucguucauaccuccacacucucuggcagcgcgcaacacguggaggaaugcuccugcuaucccagauacccuggggugcggugugucugccgcgauaauuggaagggaagcaacagacccauuguggacaucaauauuaaagaucacucuaucguuuccagcuacguguguucuggccuggucggcgacaccccgcggaagaacgacagcuccucuagcucccauugccuugauccuaauaacgaggaagggggacacggcgugaaagggugggccuucgacgauggaaaugacguuuggaugggccgcacgauuaacgagacaagcagacugggguaugagaccuuuaaggugaucgaaggauggucuaaucccaaauccaagcuccagaucaaccggcaggucauuguggaucgcggcgacagaagcggcuacucugggaucuucuccgucgagggaaaaagcuguauuaaucggugcuuuuauguggaacugaucagaggccgcaaggaggaaaccgagguucuguggacauccaacucuauuguggucuucugugggaccagcggaacauacggcacgggguccuggccugauggcgcugaccucaaucugaugcccaucuga

SEQ ID NO: 207782 - RNA, 1410 nt, Artificial Sequence; identical to SEQ ID NO: 205170
  derived and/or modified sequence opt5 from neuraminidase__InfluenzaA__AHL96036

SEQ ID NO: 207783 - RNA, 1410 nt, Artificial Sequence; identical to SEQ ID NO: 206413
  derived and/or modified sequence opt5 from neuraminidase__InfluenzaA__AHL96048

SEQ ID NO: 207784 - RNA, 1410 nt, Artificial Sequence; identical to SEQ ID NO: 205170
  derived and/or modified sequence opt5 from neuraminidase__InfluenzaA__AHL96059

SEQ ID NO: 207785 - RNA, 1410 nt, Artificial Sequence; identical to SEQ ID NO: 206907
  derived and/or modified sequence opt5 from neuraminidase__InfluenzaA__AHL96071

SEQ ID NO: 207786 - RNA, 1410 nt, Artificial Sequence; identical to SEQ ID NO: 207748
  derived and/or modified sequence opt5 from neuraminidase__InfluenzaA__AHL96083

SEQ ID NO: 207787 - RNA, 1410 nt, Artificial Sequence; identical to SEQ ID NO: 205170
  derived and/or modified sequence opt5 from neuraminidase__InfluenzaA__AHL96095

SEQ ID NO: 207788 - RNA, 1410 nt, Artificial Sequence
  derived and/or modified sequence opt5 from neuraminidase__InfluenzaA__AHL96107
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacaacagcuccucuagccauugccuugauccuaauaacgaggaagggggacacggcgucaaagggugggccuucgacgauggaaaugacguguggaugggccgcacgaucaacgagacauccagacugggguaugagaccuuuaagguuaucgaaggauggagcaaucccaaaucuaagcuccagauuaaccgccaggugaucgucgaucggggcgacagauccggcuacagcgggauuuucucuguggagggaaaauccuguaucaaucggugcuuuuaugucgaacugauuagaggccgcaaggaggaaaccgaggugcuguggacaagcaacuccaucguuguguucugugggaccucuggaacauacggcacggggagcuggccugauggcgcugaccucaaucugaugcccauuuga

SEQ ID NO: 207789 - RNA, 1410 nt, Artificial Sequence; identical to SEQ ID NO: 205170
  derived and/or modified sequence opt5 from neuraminidase__InfluenzaA__AHL96119

SEQ ID NO: 207790 - RNA, 1410 nt, Artificial Sequence; identical to SEQ ID NO: 206907
  derived and/or modified sequence opt5 from neuraminidase__InfluenzaA__AHL96131

SEQ ID NO: 207791 - RNA, 1410 nt, Artificial Sequence; identical to SEQ ID NO: 205170
  derived and/or modified sequence opt5 from neuraminidase__InfluenzaA__AHL96143

SEQ ID NO: 207792 - RNA, 1410 nt, Artificial Sequence; identical to SEQ ID NO: 205170
  derived and/or modified sequence opt5 from neuraminidase__InfluenzaA__AHL96167

SEQ ID NO: 207793 - RNA, 1410 nt, Artificial Sequence; identical to SEQ ID NO: 205170
  derived and/or modified sequence opt5 from neuraminidase__InfluenzaA__AHL96179

SEQ ID NO: 207794 - RNA, 1410 nt, Artificial Sequence
  derived and/or modified sequence opt5 from neuraminidase__InfluenzaA__AHL96191
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaauaugcauagcaacaauaccgugcgggaucgcacgcccuauagaacacugcucaugaacgaacuggggguuccuuuucaccugggaaccaaacaggugugcauugccugguccucuagcuccugucaugacggcaaggccuggcuccacgucugcaucacaggcgaugacaagaaugcuaccgccagcuucauuuacaacgggcggcugguggauucuguuguguccuggagcaaagagauccuucgcacccaggaaucugagugugucugcauuaauggaacauguacgguggugaugaccgacggcuccgcuagcgggaaggccgauacaaaaauccuguuuaucgaggaaggaaagauuguccauaccuccacacucucuggcagcgcgcaacacguugaggaaugcuccugcuaucccagauacccuggggugcggugugugugccgcgacaacuggaagggaagcaacagacccaucgucgauauuaauaucaaagaccacucuauuguguccagcuacguuuguucuggccuggugggcgacaccccgcggaagaacgauagcuccucuagcucccauugccuugacccuaauaacgaggaagggggacacggcgucaaagggugggccuucgaugacggaaaugauguguggaugggccgcacgaucaacgagacaagcagacugggguaugagaccuuuaagguuaucgaaggauggucuaaucccaaauccaagcuccagauuaaccgccaggugaucgucgaccggggcgauagaagcggcuacucugggauuuucuccguggagggaaaaagcuguaucaaucggugcuuuuaugucgaacugauuagaggccgcaaggaggaaaccgaggugcuguggacauccaacucuaucguuguguucugugggaccagcggaacauacggcacgggguccuggccugacggcgcugaucucaaucugaugcccauuuga

SEQ ID NO: 207795 - RNA, 1410 nt, Artificial Sequence; identical to SEQ ID NO: 206895
  derived and/or modified sequence opt5 from neuraminidase__InfluenzaA__AHL96203

SEQ ID NO: 207796 - RNA, 1410 nt, Artificial Sequence; identical to SEQ ID NO: 206907
  derived and/or modified sequence opt5 from neuraminidase__InfluenzaA__AHL96215

SEQ ID NO: 207797 - RNA, 1410 nt, Artificial Sequence; identical to SEQ ID NO: 205170
  derived and/or modified sequence opt5 from neuraminidase__InfluenzaA__AHL96227

SEQ ID NO: 207798 - RNA, 1410 nt, Artificial Sequence; identical to SEQ ID NO: 205170
  derived and/or modified sequence opt5 from neuraminidase__InfluenzaA__AHL96239

SEQ ID NO: 207799 - RNA, 1410 nt, Artificial Sequence; identical to SEQ ID NO: 205170
  derived and/or modified sequence opt5 from neuraminidase__InfluenzaA__AHL96251

SEQ ID NO: 207800 - RNA, 1410 nt, Artificial Sequence; identical to SEQ ID NO: 205170
  derived and/or modified sequence opt5 from neuraminidase__InfluenzaA__AHL96263

SEQ ID NO: 207801 - RNA, 1410 nt, Artificial Sequence; identical to SEQ ID NO: 206951
  derived and/or modified sequence opt5 from neuraminidase__InfluenzaA__AHL96277

SEQ ID NO: 207802 - RNA, 1410 nt, Artificial Sequence
  derived and/or modified sequence opt5 from neuraminidase__InfluenzaA__AHL96308
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacccgcugaguaccggaauuggagcaagccucagugugggauuaccggauuugcccccuucuccaaagacaacucuauccgccucagcgcgggcggggauaucugggugacaagagagccuuaugucuccugcgacccggauaaguguuaccaauuugcucugggacagggcaccacacuuaauaacgugcauucuaauaacaccguucgggaccgcacgcccuauagaacacugcucaugagcgaacugggggugccuuuccaccugggaaccaagcaggucugcauugccugguccuccucuuccugucaugauggcaaagccuggcuccacgugugcaucacaggcgacgauaagaaugcuaccgccagcuuuauuuacaacgggcggcugguugacucuguggucuccuggagcaaagagauccuucgcacccaggaaucugagugugugugcauuaauggaacauguacgguggucaugaccgauggcuccgcuagcgggaaggccgacacaaaaauccuguucaucgaggaaggaaagauuguucauaccuccacacucucuggcagcgcgcaacacguggaggaaugcuccugcuaucccagauacccuggggugcggugugucugccgcgauaacuggaagggaagcaacagacccaucguggacauuaauaucaaagaucacucuauuguuuccagcuacguguguucuggccuggucggcgacaccccgcggaagaacgacagcuccucuagcucccauugccuugauccuaauaacgaggaagggggacacggcgugaaagggugggccuuugacgauggaaaugacguuuggaugggccgcacgaucaacgagacaagcagacugggguaugagaccuucaaggugaucgaaggauggucuaaucccaaauccaagcuccagauuaaccggcaggucaucguggaucgcggcgacagaagcggcuacucugggauuuuuagcgucgagggaaaaagcuguaucaaucggugcuucuauguggaacugauuagaggccgcaaggaggaaaccgagguucuguggacauccaacucuaucguggucuucugugggaccagcggaacauacggcacgggguccuggccugauggcgcugaccucaaucugaugcccauuuga

SEQ ID NO: 207803 - RNA, 1410 nt, Artificial Sequence; identical to SEQ ID NO: 206399
  derived and/or modified sequence opt5 from neuraminidase__InfluenzaA__AHL96321

SEQ ID NO: 207804 - RNA, 1410 nt, Artificial Sequence; identical to SEQ ID NO: 205170
  derived and/or modified sequence opt5 from neuraminidase__InfluenzaA__AHL96333

SEQ ID NO: 207805 - RNA, 1410 nt, Artificial Sequence
  derived and/or modified sequence opt5 from neuraminidase__InfluenzaA__AHL96345
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacaacagcuccucuagccauugccuugauccuaauaacgaggaagggggacacggcgugaaagggugggccuucgacgauggaaaugacguuuggaugggccgcacgaucaacgagacauccagacugggguaugagaccuuuaaggugaucgaaggauggagcaaucccaaaucuaagcuccagauuaaccggcaggucaucguggaucgcggcgacagauccggcuacagcgggauuuucucugucgagggaaaauccuguaucaaucggugcuuuuauguggaacugauuagaggccgcaaggaggaaaccgagguucuguggacaagcaacuccaucguggucuucugugggaccucuggaacauacggcacggggagcuggccugauggcgcugaccucaaucugaugcccauuuga

SEQ ID NO: 207806 - RNA, 1410 nt, Artificial Sequence; identical to SEQ ID NO: 206895
  derived and/or modified sequence opt5 from neuraminidase__InfluenzaA__AHL96357

SEQ ID NO: 207807 - RNA, 1410 nt, Artificial Sequence; identical to SEQ ID NO: 205170
  derived and/or modified sequence opt5 from neuraminidase__InfluenzaA__AHL96369

SEQ ID NO: 207808 - RNA, 1410 nt, Artificial Sequence; identical to SEQ ID NO: 205170
  derived and/or modified sequence opt5 from neuraminidase__InfluenzaA__AHL96381

SEQ ID NO: 207809 - RNA, 1410 nt, Artificial Sequence; identical to SEQ ID NO: 206907
  derived and/or modified sequence opt5 from neuraminidase__InfluenzaA__AHL96393

SEQ ID NO: 207810 - RNA, 1410 nt, Artificial Sequence
  derived and/or modified sequence opt5 from neuraminidase__InfluenzaA__AHL96405
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugggccuaacaaugaggaaggaggccacggggugaaaggaugggccuucgaugacggcaacgauguuuggauggggcgcacgaucaaugagacaagcagacugggauaugagaccuuuaaggugaucgaaggcuggucuaaccccaaauccaagcuccagauuaaucggcaggucaucguggaccgcggcgauagaagcggguacucuggaauuuucuccgucgagggcaaaagcuguaucaaccggugcuuuuauguggaacugauuagagggcgcaaggaggaaaccgagguucuguggacauccaauucuaucguggucuucuguggaaccagcggcacauacgggacgggcuccuggccugacggagcugaucucaaccugaugcccauuuga

SEQ ID NO: 207811 - RNA, 1410 nt, Artificial Sequence; identical to SEQ ID NO: 205170
  derived and/or modified sequence opt5 from neuraminidase__InfluenzaA__AHL96417

SEQ ID NO: 207812 - RNA, 1410 nt, Artificial Sequence; identical to SEQ ID NO: 205170
  derived and/or modified sequence opt5 from neuraminidase__InfluenzaA__AHL96429

SEQ ID NO: 207813 - RNA, 1410 nt, Artificial Sequence
  derived and/or modified sequence opt5 from neuraminidase__InfluenzaA__AHL96441
augaaccccaaucagaagaucauuaccaucggcagcgugucccugacaauuucuacgaucugcuucuuuaugcaaauugccauccucaucaccacagucacccugcacuucaaacauuacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaguucgcucuggggcaaggaaccacacuuaauaacgugcacagcaauaacaccguucgggaucgcacgcccuauagaacacugcucaugaaugaacugggcgugccuuuucaucuggggaccaagcaggucugcauugccugguccucuagcuccugucacgacggaaaagccuggcuccaugugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucacaccuccacacucucuggaagcgcgcagcacguggaggaaugcuccugcuaucccagauacccuggcgugcggugugucugccgcgacaacuggaaggggagcaauagacccaucguggauauuaacaucaaagaccauucuauuguuucccgguacguguguagcggacuggucggcgacaccccgcgcaagaaugauucuagcuccucuagccacugccuuaacccuaauaacgaggaaggcgggcauggagugaaaggcugggccuucgacgaugggaaugacguuuggaugggaagaacgaucaacgagacaucccggcugggcuaugagaccuuuaaggugaucgaaggguggagcaaucccaaaucuaagcuccaaauuaaccgccagaucauugucgauagaggagaccgguccggcuacagcggcaucuucucuguggaggggaaauccuguauuaauagaugcuuuuaugucgaacugauccgcggacggaaggaggaaaccgaggugcuguggacaagcaacuccauuguuguguucuguggcaccucugggacauacggaacgggcagcuggccugauggggcugaccucaaucugaugcccaucuga

SEQ ID NO: 207814 - RNA, 1410 nt, Artificial Sequence; identical to SEQ ID NO: 205170
  derived and/or modified sequence opt5 from neuraminidase__InfluenzaA__AHL96453

SEQ ID NO: 207815 - RNA, 1410 nt, Artificial Sequence; identical to SEQ ID NO: 205170
  derived and/or modified sequence opt5 from neuraminidase__InfluenzaA__AHL96465

SEQ ID NO: 207816 - RNA, 1410 nt, Artificial Sequence
  derived and/or modified sequence opt5 from neuraminidase__InfluenzaA__AHL96477
augaaccccaaucagaagaucauuaccaucggcagcgugugcaugacaauugggauggccaaccugauccuccaaauuggaaauaucaucuccauuuggaucucucacagcauucaggucggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuucaaucagaaccucgaauaucagaucggauacauuuguagcggcaucuuuggggauaauccucgccccaacgacaaaaccggaucuugcggcccgguguccagcaauggggccaacggaguuaagggcuucuccuuuaaguauggcaaugggguguggauuggaagaacaaaaucuaucagcucccggaagggcuucgagaugauuugggauccuaacggguggaccggaaccgacaacaauuuuucuaucaaacaagacaucgucggcauuaacgaauggagcggguacuccggcagcuucgugcagcaucccgagcugacaggacuugauuguauccgcccuugcuucuggguugaacugauuagaggccggcccaaggagaauacgaucuggaccucuggguccagcauuucuuuuuguggagugaacuccgacacagucggcuggagcuggcccgauggggcugagcucccuuucaccaucgacaaauga

SEQ ID NO: 207817 - RNA, 1410 nt, Artificial Sequence; identical to SEQ ID NO: 206907
  derived and/or modified sequence opt5 from neuraminidase__InfluenzaA__AHL96488

SEQ ID NO: 207818 - RNA, 1410 nt, Artificial Sequence; identical to SEQ ID NO: 205170
  derived and/or modified sequence opt5 from neuraminidase__InfluenzaA__AHL96500

SEQ ID NO: 207819 - RNA, 1410 nt, Artificial Sequence; identical to SEQ ID NO: 205170
  derived and/or modified sequence opt5 from neuraminidase__InfluenzaA__AHL96512

SEQ ID NO: 207820 - RNA, 1410 nt, Artificial Sequence; identical to SEQ ID NO: 206399
  derived and/or modified sequence opt5 from neuraminidase__InfluenzaA__AHL96524

SEQ ID NO: 207821 - RNA, 1410 nt, Artificial Sequence
  derived and/or modified sequence opt5 from neuraminidase__InfluenzaA__AHL96536
augaaccccaaucagaagaucauuaccaucggcagcgugucccugacaauuucuacgaucugcuucuuuacccaaauugccauccucaucacaaccgucacacugcacuucaaacaguacgaguuuaacagcccuccgaauaaccagguuaugcuuugugaacccaccauuaucgagagaaauauuacagaaaucguguaucugaccaacacgaccauugagaaggaaaucugcccuaaacccgcugaguaccggaauugguccaagccucagugugggauuacaggauucgcccccuuuucuaaagacaacagcauccgccucuccgcgggcggggauaucugggugaccagagagccuuaugucucuugcgacccggauaaguguuaccaauucgcucugggacagggcacaaccauuaauaacgugcauagcaauaacacgguucgggaccgcacacccuauagaacccuucugaugaaugaacucggggugccuuuucaccugggaacaaagcaggucugcaucgccugguccucuagcuccugucaugauggcaaagccuggcugcacgugugcauuaccggcgacgauaagaacgcuaccgccagcuucaucuacaaugggcggcucguugacucuguggucuccuggagcaaagagauucugcgcacacaggaaucugagugugugugcaucaacggaacguguaccguggucaugacagauggcuccgcuagcgggaaggccgacaccaaaauccuuuuuauugaggaaggaaagaucguucauacauccacccugucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccucgucggcgacacgccgcggaagaaugacagcuccucuagcucccauugccuggauccuaacaaugaggaagggggacacggcgugaaagggugggccuucgacgauggaaacgacguuuggaugggccgcacaaucaaugagaccagcagacuuggguaugagaccuuuaaggugauugaaggauggucuaaccccaaauccaagcugcagaucaaucggcaggucauuguggaucgcggcgacagaagcggcuacucugggaucuucuccgucgagggaaaaagcuguauuaaccggugcuuuuauguggaacucaucagaggccgcaaggaggaaacagagguucuguggaccuccaauucuauuguggucuucugugggacaagcggaacguacggcaccggguccuggccugauggcgcugaccugaaccucaugcccaucuga

SEQ ID NO: 207822 - RNA, 1410 nt, Artificial Sequence; identical to SEQ ID NO: 206907
  derived and/or modified sequence opt5 from neuraminidase__InfluenzaA__AHL96548

SEQ ID NO: 207823 - RNA, 1410 nt, Artificial Sequence
  derived and/or modified sequence opt5 from neuraminidase__InfluenzaA__AHL96560
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcaacgcuuccgggaaggccgacacaaaaauccuguuuaucgaggaaggaaagauuguucauaccagcacacucuccggcucugcgcaacacguggaggaaugcagcugcuaucccagauacccuggggugcggugugucugccgcgauaauuggaagggauccaacagacccaucguggacauuaauaucaaagaucacagcauuguuucuuccuacguguguagcggccuggucggcgacaccccgcggaagaacgacucuagcuccucuagccauugccuugauccuaauaacgaggaagggggacacggcgugaaagggugggccuucgacgauggaaaugacguuuggaugggccgcacgaucaacgagacauccagacugggguaugagaccuuuaaggugaucgaaggauggagcaaucccaaaucuaagcuccagauuaaccggcaggucaucguggaucgcggcgacagauccggcuacagcgggauuuucucugucgagggaaaauccuguaucaaucggugcuuuuauguggaacugauuagaggccgcaaggaggaaaccgagguucuguggacaagcaacuccaucguggucuucugugggaccucuggaacauacggcacggggagcuggccugauggcgcugaccucaaucugaugcccauuuga

SEQ ID NO: 207824 - RNA, 1410 nt, Artificial Sequence; identical to SEQ ID NO: 206381
  derived and/or modified sequence opt5 from neuraminidase__InfluenzaA__AHL96572

SEQ ID NO: 207825 - RNA, 1410 nt, Artificial Sequence; identical to SEQ ID NO: 207816
  derived and/or modified sequence opt5 from neuraminidase__InfluenzaA__AHL96584

SEQ ID NO: 207826 - RNA, 1410 nt, Artificial Sequence
  derived and/or modified sequence opt5 from neuraminidase__InfluenzaA__AHL96595
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagagcaaauccuguaucaaccggugcuuuuauguggaacugauuagaggacgcaaggaggaaaccgagguucuguggacaucuaauagcaucguggucuucuguggcaccuccgggacauacggaacgggcucuuggccugauggggcugaccucaaccugaugcccauuuga

SEQ ID NO: 207827 - RNA, 1410 nt, Artificial Sequence; identical to SEQ ID NO: 205170
  derived and/or modified sequence opt5 from neuraminidase__InfluenzaA__AHL96607

SEQ ID NO: 207828 - RNA, 1410 nt, Artificial Sequence
  derived and/or modified sequence opt5 from neuraminidase__InfluenzaA__AHL96631
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccaaaccugcugaguaccggaauugguccaagccccagugugggauuaccggauucgccccuuuuucuaaagacaacagcauccgccuguccgcgggcggggauaucugggugacaagagagcccuaugucucuugcgacccugauaaguguuaccaauucgcucuuggacagggcaccacacugaauaacaugcauagcaauaacaccgugcgggaccgcacgccguauagaacacuccugaugaaugaacuggggguucccuuucaccucggaaccaaacaggugugcauugccugguccucuagcuccugucaugauggcaaggccuggcugcacgucugcaucacaggcgacgauaagaacgcuaccgccagcuucauuuacaaugggcggcuuguggacucuguuguguccuggagcaaagagauccugcgcacccaggaaucugagugugucugcauuaacggaacauguacgguggugaugaccgauggcuccgcuagcgggaaggccgacacaaaaauccucuuuaucgaggaaggaaagauuguccauaccuccacacugucuggcagcgcgcaacacguugaggaaugcuccugcuauccuagauaccccggggugcggugugugugccgcgauaacuggaagggaagcaauagaccuaucgucgacauuaacaucaaagaucacucuauuguguccagcuacguuuguucuggccuugugggcgacacgccccggaagaaugacagcuccucuagcucccauugccuggauccgaacaaugaggaagggggacacggcgucaaagggugggccuucgacgauggaaacgacguguggaugggccgcaccaucaaugagacaagcagacucggguaugagaccuuuaagguuaucgaaggauggucuaacccuaaauccaagcugcagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcucuggacauccaauucuaucguuguguucugugggaccagcggaacauacggcacgggguccuggcccgauggcgcugaccugaaccuuaugccuauuuga

SEQ ID NO: 207829 - RNA, 1410 nt, Artificial Sequence; identical to SEQ ID NO: 206907
  derived and/or modified sequence opt5 from neuraminidase__InfluenzaA__AHL96643

SEQ ID NO: 207830 - RNA, 1410 nt, Artificial Sequence; identical to SEQ ID NO: 205170
  derived and/or modified sequence opt5 from neuraminidase__InfluenzaA__AHL96655

SEQ ID NO: 207831 - RNA, 1410 nt, Artificial Sequence; identical to SEQ ID NO: 205170
  derived and/or modified sequence opt5 from neuraminidase__InfluenzaA__AHL96667

SEQ ID NO: 207832 - RNA, 1410 nt, Artificial Sequence; identical to SEQ ID NO: 205170
  derived and/or modified sequence opt5 from neuraminidase__InfluenzaA__AHL96679

SEQ ID NO: 207833 - RNA, 1410 nt, Artificial Sequence; identical to SEQ ID NO: 205170
  derived and/or modified sequence opt5 from neuraminidase__InfluenzaA__AHL96691

SEQ ID NO: 207834 - RNA, 1410 nt, Artificial Sequence; identical to SEQ ID NO: 205170
  derived and/or modified sequence opt5 from neuraminidase__InfluenzaA__AHL96703

SEQ ID NO: 207835 - RNA, 1410 nt, Artificial Sequence; identical to SEQ ID NO: 206895
  derived and/or modified sequence opt5 from neuraminidase__InfluenzaA__AHL96763

SEQ ID NO: 207836 - RNA, 1410 nt, Artificial Sequence; identical to SEQ ID NO: 207748
  derived and/or modified sequence opt5 from neuraminidase__InfluenzaA__AHL96787

SEQ ID NO: 207837 - RNA, 1410 nt, Artificial Sequence
  derived and/or modified sequence opt5 from neuraminidase__InfluenzaA__AHL96799
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaugagaccgaaguucuguggacauccaauucuaucguggucuucugugggaccagcggaacauacggcacgggguccuggccugacggcgcugaucucaaccugaugcccauuuga

SEQ ID NO: 207838 - RNA, 1410 nt, Artificial Sequence; identical to SEQ ID NO: 206907
  derived and/or modified sequence opt5 from neuraminidase__InfluenzaA__AHL96811

SEQ ID NO: 207839 - RNA, 1410 nt, Artificial Sequence; identical to SEQ ID NO: 206907
  derived and/or modified sequence opt5 from neuraminidase__InfluenzaA__AHL96823

SEQ ID NO: 207840 - RNA, 1410 nt, Artificial Sequence; identical to SEQ ID NO: 205170
  derived and/or modified sequence opt5 from neuraminidase__InfluenzaA__AHL96847

SEQ ID NO: 207841 - RNA, 1410 nt, Artificial Sequence
  derived and/or modified sequence opt5 from neuraminidase__InfluenzaA__AHL96859
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugugucuugcgacccggauaaguguuaccaauucgcucugggacagggcaccacacuuaauaacguccauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuaucguuguguucugugggaccagcggaacauacggcacgggguccuggccugauggcgcugaccucaaccugaugcccauuuga

SEQ ID NO: 207842 - RNA, 1410 nt, Artificial Sequence
  derived and/or modified sequence opt5 from neuraminidase__InfluenzaA__AHL96871
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuguggagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagaggugcuucgcacccaggaaucugagugugucugcauuaacggaacaugugcuguugugaugacggauggcuccgccagcgggaaggcggacaccaaaauccuguuuauugaggaaggaaagaucgugcauacauccacccucucuggcagcgcccaacacgucgaggaaugcuccugcuaucccagauacccuggggugcgguguguuugccgcgauaacuggaagggaagcaauagacccaucguggacauuaacaucaaagaucacucuauugucuccagcuacguguguucuggccugguuggcgacacaccgcggaagaaugaccgcagcuccucuagccauugccuugauccuaacaaugaggaagggggacacggcgugaaagggugggcuuucgacgauggaaacgacgucuggaugggcagaaccaucaaugagacgucccggcugggguaugagacauuuaaggugauugaaggauggagcaaccccaaaucuaagcuccagaucaaucgccaggucaucguggauagaggcgaccgguccggcuacagcgggauuuucucuguugagggaaaauccuguaucaacagaugcuuuuauguggaacugauucgcggccggaaggaggaaaccgagguccuguggaccagcaauuccaucgugguuuucugugggacaucuggaaccuacggcacagggagcuggccugauggcgccgaccucaaccugaugcccauuuga

SEQ ID NO: 207843 - RNA, 1410 nt, Artificial Sequence
  derived and/or modified sequence opt5 from neuraminidase__InfluenzaA__AHL96883
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaauccgcugaguaccggaauuggucuaagccccagugugggauuaccggauucgccccuuuuagcaaagacaacuccauccgccucucugcgggcggggauaucugggugacaagagagcccuaugucagcugcgacccugauaaguguuaccaauucgcucugggacagggcaccacacuuaauaacaugcauuccaauaacaccgugcgggaccgcacgccguauagaacacugcucaugaaugaacuggggguucccuuucaccugggaaccaaacaggugugcauugccuggucuagcuccagcugucaugauggcaaggccuggcuccacgucugcaucacaggcgacgauaagaacgcuaccgccucuuucauuuacaaugggcggcugguggacuccguugugagcuggucuaaagagauccuucgcacccaggaauccgagugugucugcauuaacggaacauguacgguggugaugaccgauggcagcgcuuccgggaaggccgacacaaaaauccuguuuaucgaggaaggaaagauuguccauaccucuacacucagcggcuccgcgcaacacguugaggaaugcagcugcuauccuagauaccccggggugcggugugugugccgcgauaacuggaagggaucuaauagaccuaucgucgacauuaacaucaaagaucacuccauugugagcucuuacguuuguagcggccuggugggcgacacgccccggaagaaugacuccucuagcuccagccauugccuugauccgaacaaugaggaagggggacacggcgucaaagggugggccuucgacgauggaaacgacguguggaugggccgcaccaucaaugagacaucuagacugggguaugagaccuuuaagguuaucgaaggaugguccaacccuaaaagcaagcuccagauuaaucgccaggugaucgucgaucggggcgacagaucuggcuacuccgggauuuucagcguggagggaaaauccuguaucaaccggugcuuuuaugucgaacugauuagaggccgcaaggaggaaaccgaggugcuguggacaucuaauagcaucguuguguucugugggaccuccggaacauacggcacggggucuuggcccgauggcgcugaccucaaccugaugccuauuuga

SEQ ID NO: 207844 - RNA, 1410 nt, Artificial Sequence; identical to SEQ ID NO: 206895
  derived and/or modified sequence opt5 from neuraminidase__InfluenzaA__AHL96895

SEQ ID NO: 207845 - RNA, 1410 nt, Artificial Sequence
  derived and/or modified sequence opt5 from neuraminidase__InfluenzaA__AHL96907
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuguggagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagaggugcuucgcacccaggaaucugagugugucugcauuaacggaacaugugcuguugugaugacggauggcuccgccagcgggaaggcggacaccaaaauccuguuuauugaggaaggaaagaucgugcauacauccacccucucuggcagcgcccaacacgucgaggaaugcuccugcuaucccagauacccuggggugcgguguguuugccgcgauaacuggaagggaagcaauagacccaucguggacauuaacaucaaagaucacucuauugucuccagcuacguguguucuggccugguuggcgacacaccgcggaagaaugacagcuccucuagcucccauugccuugauccuaacaaugaggaagggggacacggcgugaaagggugggcuuucgacgauggaaacgacgucuggaugggccgcaccaucaaugagacgagcagacugggguaugagacauuuaaggugauugaaggauggucuaaccccaaauccaagcuccagaucaaucggcaggucaucguggaucgcggcgacagaagcggcuacucugggauuuucuccguugagggaaaaagcuguaucaaccggugcuuuuauguggaacugauuagaggccgcaaggaggaaaccgagguccuguggaccuccaauucuaucgugguuuucugugggacaagcggaaccuacggcacaggguccuggccugauggcgccgaccucaaccugaugcccauuuga

SEQ ID NO: 207846 - RNA, 1410 nt, Artificial Sequence; identical to SEQ ID NO: 206907
  derived and/or modified sequence opt5 from neuraminidase__InfluenzaA__AHL96919

SEQ ID NO: 207847 - RNA, 1410 nt, Artificial Sequence; identical to SEQ ID NO: 206907
  derived and/or modified sequence opt5 from neuraminidase__InfluenzaA__AHL96931

SEQ ID NO: 207848 - RNA, 1410 nt, Artificial Sequence; identical to SEQ ID NO: 206907
  derived and/or modified sequence opt5 from neuraminidase__InfluenzaA__AHL96943

SEQ ID NO: 207849 - RNA, 1410 nt, Artificial Sequence
  derived and/or modified sequence opt5 from neuraminidase__InfluenzaA__AHL96955
augaaccccaaucagaagaucauuaccaucggcagcgugucccugacaauuucuacgaucugcuucuuuaugcaaauugccauccucaucaccacagucacccugcacuucaaacaguacgaguuuaacagcccuuccaauaaccagguuaugcuuugugaaccgacaauuaucgagagaaauauuaccgaaaucguguaucugacaaacaccacgauugagaaggaaaucugccccaaaccugcugaguaccggaauuggucuaagccccagugugggauuaccggauucgccccuuuuagcaaagacaacuccauccgccucucugcgggcgggaauaucugggugacaagagagcccuaugucagcugcgauccugacaaguguuaccaauucgcucugggacagggcaccacacuuaacaaugugcauuccaacaauaccguucgggaucgcacgccguauagaacacugcucaugaacgaacugggggugcccuuucaccugggaaccaagcaggucugcauugccuggucuagcuccagcugucaugacggcaaagccuggcuccacgugugcaucacaggcgaugacaagaaugcuaccgccucuuucauuuacaacgggcggcugguugauuccguggucagcuggucuaaagagauccuucgcacccaggaauccgagugugugugcauuaacggaacauguacgguggucaugaccgacggcagcgcuuccgggaaggccgauacaaaaauccuguuuaucgaggaaggaaagauuguucauaccucuacacucagcggcuccgcgcaacacguggaggaaugcagcugcuauccuagauaccccggggugcggugugucugccgcgacaauuggaagggaucuaacagaccuaucguggauauuaauaucaaagaccacuccauuguuagcucuuacguguguagcggccuggucggcgauacgccccggaagaacgacuccucuagcuccagccauugccuugacccgaauaacgaggaagggggacacggcgugaaagggugggccuucgaugacggaaaugauguuuggaugggccgcaccaucaacgagacaucuagacugggguaugagaccuuuaaggugaucgaaggaugguccaauccuaaaagcaagcuccagauuaaccggcaggucaucguggaccgcggcgauagaucuggcuacuccgggauuuucagcgucgagggaaaauccuguaucaaucggugcuuuuauguggaacugauuagaggccgcaaggaggaaaccgagguucuguggacaucuaacagcaucguggucuucugugggaccuccggaacauacggcacggggucuuggcccgacggcgcugaucucaaucugaugccuauuuga

SEQ ID NO: 207850 - RNA, 1410 nt, Artificial Sequence; identical to SEQ ID NO: 207748
  derived and/or modified sequence opt5 from neuraminidase__InfluenzaA__AHL96967

SEQ ID NO: 207851 - RNA, 1410 nt, Artificial Sequence
  derived and/or modified sequence opt5 from neuraminidase__InfluenzaA__AHL96979
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacaugcauagcaauaacaccgugcgggaucgcacgcccuauagaacacugcucaugaaugaacugggcguuccuuuucaccuggggaccaaacaggugugcauugccugguccucuagcuccugucaugacggaaaggccuggcuccacgucugcaucacaggcgaugacaagaacgcuaccgccagcuucauuuacaauggccggcugguggauucuguuguguccuggagcaaagagauccuucgcacccaggaaucugagugugucugcauuaacgggacauguacgguggugaugaccgacggauccgcuagcggcaaggccgauacaaaaauccuguuuaucgaggaagggaagauuguccauaccuccacacucucuggaagcgcgcaacacguugaggaaugcuccugcuaucccagauacccuggcgugcggugugugugccgcgacaacuggaaggggagcaauagacccaucgucgauauuaacaucaaagaccacucuauuguguccagcuacguuuguucuggacuggugggcgacaccccgcggaagaaugauagcuccucuagcucccauugccuugacccuaacaaugaggaaggcgggcacggagucaaaggcugggccuucgaugacgggaacgauguguggaugggacgcacgaucaaugagacaagcagacugggcuaugagaccuuuaagguuaucgaaggguggucuaaccccaaauccaagcuccagauuaaucgccaggugaucgucgaccggggagauagaagcggcuacucuggcauuuucuccguggaggggaaaagcuguaucaaccggugcuuuuaugucgaacugauuagaggacgcaaggaggaaaccgaggugcuguggacauccaauucuaucguuguguucuguggcaccagcgggacauacggaacgggcuccuggccugacggggcugaucucaacauuaugcccaucuga

SEQ ID NO: 207852 - RNA, 1410 nt, Artificial Sequence; identical to SEQ ID NO: 206907
  derived and/or modified sequence opt5 from neuraminidase__InfluenzaA__AHL96991

SEQ ID NO: 207853 - RNA, 1410 nt, Artificial Sequence; identical to SEQ ID NO: 205170
  derived and/or modified sequence opt5 from neuraminidase__InfluenzaA__AHL97003

SEQ ID NO: 207854 - RNA, 1410 nt, Artificial Sequence
  derived and/or modified sequence opt5 from neuraminidase__InfluenzaA__AHL97015
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcagaucauugucgaucgcggcgacagaagcggcuacucugggaucuucuccguggagggaaaaagcuguauuaaccggugcuuuuaugucgaacugaucagaggccgcaaggaggaaaccgaggugcuguggacauccaauucuauuguuguguucugugggaccagcggaacauacggcacgggguccuggccugauggcgcugaccucaaccugaugcccaucuga

SEQ ID NO: 207855 - RNA, 1410 nt, Artificial Sequence; identical to SEQ ID NO: 205170
  derived and/or modified sequence opt5 from neuraminidase__InfluenzaA__AHL97027

SEQ ID NO: 207856 - RNA, 1410 nt, Artificial Sequence
  derived and/or modified sequence opt5 from neuraminidase__InfluenzaA__AHL97039
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcaacgcuuccgggaaggccgacacaaaaauccuguuuaucgaggaaggaaagauuguucauaccagcacacucuccggcucugcgcaacacguggaggaaugcagcugcuaucccagauacccuggggugcggugugucugccgcgauaauuggaagggauccaacagacccaucguggacauuaauaucaaagauuacagcauuguuucuuccuauguguguagcggccuggucggcgacaccccgcggaagaacgacucuagcuccucuagccacugccuugauccuaauaacgaggaagggggacauggcgugaaagggugggccuucgacgauggaaaugacguuuggaugggccgcacgaucaacgagacauccagacugggguacgagaccuuuaaggugaucgaaggauggagcaaucccaaaucuaagcuccagauuaaccggcaggucaucguggaucgcggcgacagauccggcuauagcgggauuuucucugucgagggaaaauccuguaucaaucggugcuuuuacguggaacugauuagaggccgcaaggaggaaaccgagguucuguggacaagcaacuccaucguggucuucugugggaccucuggaacauauggcacggggagcuggccugauggcgcugaccucaaucugaugcccauuuga

SEQ ID NO: 207857 - RNA, 1410 nt, Artificial Sequence; identical to SEQ ID NO: 205170
  derived and/or modified sequence opt5 from neuraminidase__InfluenzaA__AHL97051

SEQ ID NO: 207858 - RNA, 1410 nt, Artificial Sequence
  derived and/or modified sequence opt5 from neuraminidase__InfluenzaA__AHL97063
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugggccuaacaaugaggaaggaggccacggggugaaaggaugggccuucgaugacggcaacgauguuuggauggggcgcacgaucaaugagacaagcagacugggauaugagaccuuuaaggugaucgacggcuggucuaaccccaaauccaagcuccagauuaaucggcaggucaucguggaucgcggcgacagaagcggguacucuggaauuuucuccgucgaaggcaaaagcuguaucaaccggugcuuuuauguggagcugauuagagggcgcaaggaagagaccgaaguucuguggacauccaauucuaucguggucuucuguggaaccagcggcacauacgggacgggcuccuggccugauggagcugaccucaaccugaugcccauuuga

SEQ ID NO: 207859 - RNA, 1410 nt, Artificial Sequence; identical to SEQ ID NO: 205170
  derived and/or modified sequence opt5 from neuraminidase__InfluenzaA__AHL97075

SEQ ID NO: 207860 - RNA, 1410 nt, Artificial Sequence; identical to SEQ ID NO: 206895
  derived and/or modified sequence opt5 from neuraminidase__InfluenzaA__AHL97087

SEQ ID NO: 207861 - RNA, 1410 nt, Artificial Sequence; identical to SEQ ID NO: 206399
  derived and/or modified sequence opt5 from neuraminidase__InfluenzaA__AHL97099

SEQ ID NO: 207862 - RNA, 1410 nt, Artificial Sequence; identical to SEQ ID NO: 205170
  derived and/or modified sequence opt5 from neuraminidase__InfluenzaA__AHL97111

SEQ ID NO: 207863 - RNA, 1410 nt, Artificial Sequence
  derived and/or modified sequence opt5 from neuraminidase__InfluenzaA__AHL97123
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggcgcaacgauagcuccucuagcucccauugccuugacccuaauaacgaggaagggggacacggcgugaaggggugggccuucgaugacggaaaugauguuuggaugggcagaacgaucaacgagacaagccggcugggguaugagaccuuuaaagugaucgaaggauggucuaaucccaaguccaaacuccagauuaaccgccaggucaucguggacagaggcgaucggagcggcuacucugggauuuucuccgucgagggaaagagcuguaucaauagaugcuuuuauguggaacugauucgcggccggaaagaggaaaccgagguucuguggacauccaacucuaucguggucuucugugggaccagcggaacauacggcacgggguccuggccugacggcgcugaucucaaucugaugcccauuuga

SEQ ID NO: 207864 - RNA, 1410 nt, Artificial Sequence; identical to SEQ ID NO: 206927
  derived and/or modified sequence opt5 from neuraminidase__InfluenzaA__AHL97135

SEQ ID NO: 207865 - RNA, 1410 nt, Artificial Sequence
  derived and/or modified sequence opt5 from neuraminidase__InfluenzaA__AHL97147
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggagaggaagcaaucggcccaucguggacauuaacaucaaggaucacucuauuguuuccagcuacguguguucuggccuggucggcgacaccccgcgcaaaaaugacagcuccucuagcucccauugccuugauccuaacaaugaggaagggggacacggcgugaaggggugggccuucgacgauggaaacgacguuuggaugggcagaacgaucaaugagacaagccggcugggguaugagaccuuuaaagugaucgaaggauggucuaaccccaaguccaaacuccagauuaaucgccaggucaucguggauagaggcgaccggagcggcuacucugggauuuucuccgucgagggaaagagcuguaucaacagaugcuuuuauguggaacugauucgcggccggaaagaggaaaccgagguucuguggacauccaauucuaucguggucuucugugggaccagcggaacauacggcacgggguccuggccugauggcgcugaccucaaccugaugcccauuuga

SEQ ID NO: 207866 - RNA, 1410 nt, Artificial Sequence; identical to SEQ ID NO: 205170
  derived and/or modified sequence opt5 from neuraminidase__InfluenzaA__AHL97159

SEQ ID NO: 207867 - RNA, 1410 nt, Artificial Sequence; identical to SEQ ID NO: 205170
  derived and/or modified sequence opt5 from neuraminidase__InfluenzaA__AHL97171

SEQ ID NO: 207868 - RNA, 1410 nt, Artificial Sequence; identical to SEQ ID NO: 205170
  derived and/or modified sequence opt5 from neuraminidase__InfluenzaA__AHL97183

SEQ ID NO: 207869 - RNA, 1410 nt, Artificial Sequence; identical to SEQ ID NO: 205170
  derived and/or modified sequence opt5 from neuraminidase__InfluenzaA__AHL97195

SEQ ID NO: 207870 - RNA, 1410 nt, Artificial Sequence; identical to SEQ ID NO: 205170
  derived and/or modified sequence opt5 from neuraminidase__InfluenzaA__AHL97207

SEQ ID NO: 207871 - RNA, 1410 nt, Artificial Sequence; identical to SEQ ID NO: 205170
  derived and/or modified sequence opt5 from neuraminidase__InfluenzaA__AHL97219

SEQ ID NO: 207872 - RNA, 1410 nt, Artificial Sequence
  derived and/or modified sequence opt5 from neuraminidase__InfluenzaA__AHL97231
augaaccccaaucagaagaucauuaccaucggcagcgugucccugacaauuucuacgaucugcuucuuuaugcaaauugccauccucaucaccacagucacccugcacuucaaacaguacgacuuuaacagcccuccgaauaaccagguuaugcuuugugagcccacaauuaucgaaagaaauauuaccgagaucguguaucugacaaacaccacgauugaaaaggagaucugcccuaaacccgcugaauaccggaauugguccaagccucagugugggauuaccggauucgcccccuuuucuaaagauaacagcauccgccucuccgcgggcggggacaucugggugacaagagagccuuaugucucuugcgauccggacaaguguuaccaauucgcucugggacagggcaccacacuuaauaacgugcauagcaauaacaccguucgggaucgcacgcccuauagaacacugcucaugaaugagcugggggugccuuuucaccugggaaccaagcaggucugcauugccugguccucuagcuccugucaugacggcaaagccuggcuccacgugugcaucacaggcgaugacaagaacgcuaccgccagcuucauuuacaaugggcggcugguugauucuguggucuccuggagcaaagaaauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuguuauuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucggaggcuggucuaaccccaaauccaagcuccagauuaaucggcaggucaucguggaccgcggcgauagaagcggguacucuggaauuuucuccgucgagggcaaaagcuguaucaaccggugcuuuuauguggaacugauuagagggcgcaaggaggaaaccgagguucuguggacauccaauucuaucguggucuucuguggaaccagcggcacauacgggacgggcuccuggccugacggagcugaucucaaccugaugcccauuuga

SEQ ID NO: 207873 - RNA, 1410 nt, Artificial Sequence
  derived and/or modified sequence opt5 from neuraminidase__InfluenzaA__AHL97243
augaaccccaaucagaagaucauuaccaucggcagcgugucccugacaauuucuacgaucugcuucuuuaugcaaauugccauccucaucaccacagucacccugaacuucaaacaguacgaguuuaauagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagacaauagcauccgccucuccgcgggcggggauaucugggugacaagagagccuuaugucucuugcgacccggauaaguguuaccaauucgcucugggacagggcaccacacuuaacaaugugcacagcaacaauaccguucgggaccgcacgcccuauagaacacugcucaugaacgaacugggggugccuuuucaucugggaaccaagcaggucugcauugccugguccucuagcuccugucacgauggcaaagccuggcuccaugugugcaucacaggcgacgauaagaaugcuaccgccagcuucauuuacaacgggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucacaccuccacacucucuggcagcgcgcaacauguggaggaaugcuccugcuaucccagauacccuggggugcggugugucugccgcgauaauuggaagggaagcaacagacccaucguggacauuaauaucaaagaucacucuauuguuuccagcuacguguguucuggccuggucggcgacaccccgcggaagaacgacagcuccucuagcucccacugccuugauccuaauaacgaggaagggggacauggcgugaaagggugggccuucgacgauggaaaugacguuuggaugggccgcacgaucaacgagacaagcagacugggguaugagaccuuuaaggugaucgaaggauggucuaaucccaaauccaagcuccagauuaaccggcaggucaucguggaucgcggcgacagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugauggcgcugaccucaaucugaugcccauuuga

SEQ ID NO: 207874 - RNA, 1410 nt, Artificial Sequence; identical to SEQ ID NO: 206399
  derived and/or modified sequence opt5 from neuraminidase__InfluenzaA__AHL97255

SEQ ID NO: 207875 - RNA, 1410 nt, Artificial Sequence
  derived and/or modified sequence opt5 from neuraminidase__InfluenzaA__AHL97267
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccgcccgggaccgcacgcccuauagaacacugcucaugaaugaacuggggguuccuuuucaccugggaaccaaacaggugugcauugccugguccucuucuuccugucaugauggcaaggcuuggcuccacgucugcaucacaggcgacgauaagaacgccaccgcuagcuucauuuacaaugggcggcugguggacucuguuguguccuggagcaaagagauccuucgcacccaggaaucugagugugucugcauuaacggaacauguacgguggugaugaccgauggcuccgccagcgggaaggcggacacaaaaauccuguuuaucgaggaaggaaagauuguccauaccuccacacucucuggcagcgcccaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuucuccucuagccauugccuugauccuaacaaugaggaagggggacacggcgucaaagggugggcuuuugacgauggaaacgacguguggaugggccgcacgaucaaugagacauccagacugggguaugagaccuucaagguuaucgaaggauggagcaaccccaaaucuaagcuccagauuaaucgccaggugaucgucgaucggggcgacagauccggcuacagcgggauuuuuagcguggagggaaaauccuguaucaaccggugcuucuaugucgaacugauuagaggccgcaaggaggaaaccgaggugcuguggacaagcaauuccaucguuguguucugugggaccucuggaacauacggcacggggagcuggccugauggcgccgaccucaaccugaugcccauuuga

SEQ ID NO: 207876 - RNA, 1410 nt, Artificial Sequence; identical to SEQ ID NO: 205170
  derived and/or modified sequence opt5 from neuraminidase__InfluenzaA__AHL97279

SEQ ID NO: 207877 - RNA, 1410 nt, Artificial Sequence; identical to SEQ ID NO: 207760
  derived and/or modified sequence opt5 from neuraminidase__InfluenzaA__AHL97291

SEQ ID NO: 207878 - RNA, 1410 nt, Artificial Sequence; identical to SEQ ID NO: 207748
  derived and/or modified sequence opt5 from neuraminidase__InfluenzaA__AHL97303

SEQ ID NO: 207879 - RNA, 1410 nt, Artificial Sequence
  derived and/or modified sequence opt5 from neuraminidase__InfluenzaA__AHL97339
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacguccuauagaacacugcucaugaacgaacugggggugcccuuucaccugggaaccaagcaggucugcauugccuggucuagcuccagcugucaugacggcaaagccuggcuccacgugugcaucacaggcgaugacaagaaugcuaccgccucuuucauuuacaacgggcggcugguugauuccguggucagcuggucuaaagagauccuucgcacccaggaauccgagugugugugcauuaauggaacauguacgguggucaugaccgacggcagcgcuuccgggagagccgauacaaagauccuguuuaucgaggaaggaaaaauuguucauaccucuacacucagcggcuccgcgcaacacguggaggaaugcagcugcuauccucgguaccccggggugcgcugugucugcagagacaacuggaagggaucuaaccggccuaucguggauauuaauaucaaggaccacuccauuguuagcucuuacguguguagcggccuggucggcgacacgccccgcaaaaacgauuccucuagcuccagccauugccuugacccgaauaacgaggaagggggacacggcgugaaggggugggccuucgaugacggaaaugauguuuggaugggcagaaccaucaacgagacaucucggcugggguaugagaccuuuaaagugaucgaaggaugguccaauccuaagagcaaacuccagauuaaccgccaggucaucguggacagaggcgaucggucuggcuacuccgggauuuucagcgucgagggaaaguccuguaucaauagaugcuuuuauguggaacugauucgcggccggaaagaggaaaccgagguucuguggacaucuaacagcaucguggucuucugugggaccuccggaacauacggcacggggucuuggcccgacggcgcugaucucaaucugaugccuauuuga

SEQ ID NO: 207880 - RNA, 1410 nt, Artificial Sequence; identical to SEQ ID NO: 206895
  derived and/or modified sequence opt5 from neuraminidase__InfluenzaA__AHL97351

SEQ ID NO: 207881 - RNA, 1410 nt, Artificial Sequence; identical to SEQ ID NO: 207760
  derived and/or modified sequence opt5 from neuraminidase__InfluenzaA__AHL97363

SEQ ID NO: 207882 - RNA, 1410 nt, Artificial Sequence; identical to SEQ ID NO: 205170
  derived and/or modified sequence opt5 from neuraminidase__InfluenzaA__AHL97387

SEQ ID NO: 207883 - RNA, 1410 nt, Artificial Sequence
  derived and/or modified sequence opt5 from neuraminidase__InfluenzaA__AHL97399
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucauguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugugucuugcgacccggauaaguguuaccaauucgcucugggacagggcaccacacuuaauaacaugcauagcaauaacaccguccgggaccgcacgcccuauagaacacugcucaugaaugaacugggggugccuuuucaccugggaaccaagcagguuugcauugccugguccucuagcuccugucaugauggcaaagccuggcuccacgugugcaucacaggcgacgauaagaacgcuaccgccagcuucauuuacaaugggcggcuggucgacucugugguuuccuggagcaaagagauccuucgcacccaggaaucugagugugugugcauuaacggaacauguacggucgugaugaccgauggcuccgcuagcgggaaggccgacacaaaaauccuguuuaucgaggaaggaaagauugugcauaccuccacacucucuggcagcgcgcaacacgucgaggaaugcuccugcuaucccagauacccugggguucggugugugugccgcgauaacuggaagggaagcaauagacccaucguggacauuaacaucaaagaucacucuauugucuccagcuacguguguucuggccugguuggcgacaccccgcggaagaaugacagcuccucuagcucccauugccuugauccuaacaaugaggaagggggacacggcgugaaagggugggccuucgacgauggaaacgacgucuggaugggccgcacgaucaaugagacaagcagacugggguaugagaccuuuaaggugaucgaaggauggucuaaccccaaauccaagcuccagauuaaucggcagguuaucguggaucgcggcgacagaagcggcuacucugggauuuucuccgucgagggacggagcuguaucaacagaugcuuuuauguggaacugauucgcggccggaaagaggaaaccgagguccuguggacauccaauucuaucgugguuuucugugggaccagcggaacauacggcacgggguccuggccugauggcgcugaccucaaccugaugcccauuuga

SEQ ID NO: 207884 - RNA, 1410 nt, Artificial Sequence; identical to SEQ ID NO: 206399
  derived and/or modified sequence opt5 from neuraminidase__InfluenzaA__AHL97411

SEQ ID NO: 207885 - RNA, 1410 nt, Artificial Sequence
  derived and/or modified sequence opt5 from neuraminidase__InfluenzaA__AHL97423
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacauguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuaucguuguguucugugggaccagcggaacauacggcacgggguccuggccugauggcgcugaccucaaccugaugcccauuuga

SEQ ID NO: 207886 - RNA, 1410 nt, Artificial Sequence
  derived and/or modified sequence opt5 from neuraminidase__InfluenzaA__AHL97447
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuucuuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuucuccucuagccauugccuugauccuaacaaugaggaagggggacacggcgugaaagggugggccuuugacgauggaaacgacguuuggaugggccgcacgaucaaugagacauccagacugggguaugagaccuucaaggugaucgaaggauggagcaaccccaaaucuaagcuccagauuaaucggcaggucaucguggaucgcggcgacagauccggcuacagcgggauuuuuagcgucgagggaaaauccuguaucaaccggugcuucuauguggaacugauuagaggccgcaaggaggaaaccgagguucuguggacaagcaauuccaucguggucuucugugggaccucuggaacauacggcacggggagcuggccugauggcgcugaccucaaccugaugcccauuuga

SEQ ID NO: 207887 - RNA, 1410 nt, Artificial Sequence; identical to SEQ ID NO: 205170
  derived and/or modified sequence opt5 from neuraminidase__InfluenzaA__AHL97459

SEQ ID NO: 207888 - RNA, 1410 nt, Artificial Sequence; identical to SEQ ID NO: 207760
  derived and/or modified sequence opt5 from neuraminidase__InfluenzaA__AHL97471

SEQ ID NO: 207889 - RNA, 1410 nt, Artificial Sequence; identical to SEQ ID NO: 206895
  derived and/or modified sequence opt5 from neuraminidase__InfluenzaA__AHL97483

SEQ ID NO: 207890 - RNA, 1410 nt, Artificial Sequence; identical to SEQ ID NO: 205170
  derived and/or modified sequence opt5 from neuraminidase__InfluenzaA__AHL97496

SEQ ID NO: 207891 - RNA, 1410 nt, Artificial Sequence; identical to SEQ ID NO: 205170
  derived and/or modified sequence opt5 from neuraminidase__InfluenzaA__AHL97508

SEQ ID NO: 207892 - RNA, 1410 nt, Artificial Sequence
  derived and/or modified sequence opt5 from neuraminidase__InfluenzaA__AHL97520
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaccugcccuaaacccgcugaguaccggaauugguccaagccucagugugggaucacaggauucgcccccuuuucuaaagacaacagcauucgccucuccgcgggcggggauaucugggugaccagagagccuuaugucucuugcggaccggacaaguguuaccaauucgcucugggccaggggacaacccuuaauaacaugcauagcaauaacacggugcgggaucgcacacccuauagaacccugcucaugaaugaacugggaguuccuuuucaccugggcacaaaacaggugugcaucgccugguccucuagcuccugucaugacggcaaggccuggcuccacgucugcauuaccggggaugacaagaacgcuaccgccagcuucaucuacaauggacggcugguggauucuguuguguccuggagcaaagagauucuucgcacacaggaaucugagugugucugcaucaacggcacguguaccguggugaugacagacggguccgcuagcggaaaggccgauaccaaaauucuguuuaucgaggaaggcaagaucguccauacauccacccucucugggagcgcgcaacacguugaggaaugcuccugcuaucccagauacccuggagugcggugugugugccgcgacaacuggaagggcagcaauagacccauugucgauaucaacauuaaagaccacucuaucguguccagcuacguuuguucuggccuggugggggauacgccgcggaagaaugacagcuccucuagcucccauugccuugacccuaacaaugaggaaggaggccacggggucaaaggaugggccuucgaugacggcaacgauguguggauggggcgcacaauuaaugagaccagcagacugggauaugagaccuuuaagguuaucgaaggcuggucuaaccccaaauccaagcuccagaucaaucgccaggugauugucgaccggggcgauagaagcggguacucuggaaucuucuccguggagggcaaaagcuguauuaaccggugcuuuuaugucgaacugaucagagggcgcaaggaggaaacagaggugcuguggaccuccaauucuauuguuguguucuguggaacaagcggcacguacgggaccggcuccuggccugacggagcugaucucaaccugaugcccaucuga

SEQ ID NO: 207893 - RNA, 1410 nt, Artificial Sequence; identical to SEQ ID NO: 205170
  derived and/or modified sequence opt5 from neuraminidase__InfluenzaA__AHL97532

SEQ ID NO: 207894 - RNA, 1410 nt, Artificial Sequence; identical to SEQ ID NO: 205170
  derived and/or modified sequence opt5 from neuraminidase__InfluenzaA__AHL97544

SEQ ID NO: 207895 - RNA, 1410 nt, Artificial Sequence; identical to SEQ ID NO: 206895
  derived and/or modified sequence opt5 from neuraminidase__InfluenzaA__AHL97556

SEQ ID NO: 207896 - RNA, 1410 nt, Artificial Sequence
  derived and/or modified sequence opt5 from neuraminidase__InfluenzaA__AHL97568
augaaccccaaucagaagaucauuaccaucggcagcgugucccugacaauuucugccaucugcuucuuuaugcaaauugcuauccucaucacgaccgucacacugagauucaaacaguacgaguuuaacagcccuccgaauaaccagguuaugcuuugugaacccaccauuaucgagcggaauauuacagaaaucguguaucugaccaacacaaccauugagaaggaaaucugcccuaaacccgccgaguaccgcaauugguccaagccucagugugacauuacgggguucgcgcccuuuucuaaagauaacagcaucagacucuccgcuggaggcgacaucugggugacccgggagccuuaugucucuugcgauccggacaaguguuaccaauucgcccuggggcagggaacaacccuuacaaaugugcacagcaacaauaccguucgcgauagaacgcccuaucggacacugcucaugaacgaacugggcgugccuuuucaucuggggaccaagcaggucugcauugccugguccucuagcuccugucacgacggaaaggcuuggcuccaugugugcaucacaggcgaugacaaaaaugccaccgcuagcuucauuuacaacggccgccugguugauucuguggucuccuggagcaaagagauccuuagaacccaggaaucugagugugugugcauuaaugggacauguacgguggucaugaccgacggauccgccagcggcaaggcggauacaaaaauccuguuuaucgaggaagggaagauuguucacaccuccacacucucuggaagcgcccaacauguggaggaaugcuccugcuauccccgguacccuggcgugcgcugugucugcagagacaacuggaaggggagcaaccggcccaucguggauauuaauaucaaagaccacucuauuguuucccgcuacguguguagcggacuggucggcgacaccccgagaaagaacgauucuagcuccucuagccacugccuugacccuaauaacgaggaaggcgggcauggagugaaaggcugggcuuucgaugacgggaaugauguuuggaugggacggacgaucaacgagacaucccgccugggcuaugagaccuuuaaggugaucgaaggguggagcaaucccaaaucuaagcuccagauuaacagacaggucaucguggaccggggagauagauccggcuacagcggcauuuucucugucgaggggaaauccuguaucaaucgcugcuuuuauguggaacugauucggggaagaaaggaggaaaccgagguucuguggacaagcaacuccaucguggucuucuguggcaccucugggacauacggaacgggcagcuggccugacggggccgaucucaaucugaugcccauuuga

SEQ ID NO: 207897 - RNA, 1410 nt, Artificial Sequence; identical to SEQ ID NO: 207810
  derived and/or modified sequence opt5 from neuraminidase__InfluenzaA__AHL97580

SEQ ID NO: 207898 - RNA, 1410 nt, Artificial Sequence
  derived and/or modified sequence opt5 from neuraminidase__InfluenzaA__AHL97592
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcgugcgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugggccuaacaaugaggaaggaggccacgggguuaaaggaugggccuucgaugacggcaacgauguguggauggggcgcacgauuaaugagacaagcagaucuggauaugagaccuuuaaggucaucgaaggcugguccaaccccaaaagcaagcugcagaucaaucgccaggugauugucgaccggggcgauagaucuggguacuccggaaucuucagcguggagggcaaauccuguauuaaccggugcuuuuauguugaacucaucagagggcgcaaggaggaaaccgaggugcuguggacaucuaauagcauugucguguucuguggaaccuccggcacauacgggacgggcucuuggccugacggagcugaucugaaccucaugcccaucuga

SEQ ID NO: 207899 - RNA, 1410 nt, Artificial Sequence; identical to SEQ ID NO: 205170
  derived and/or modified sequence opt5 from neuraminidase__InfluenzaA__AHL97604

SEQ ID NO: 207900 - RNA, 1410 nt, Artificial Sequence
  derived and/or modified sequence opt5 from neuraminidase__InfluenzaA__AHL97616
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagguccuucgcacccaggaaucugagugugugugcaucaacggaacauguacgguggucaugaccgauggcuccgcuagcgggaaggccgacacaaaaauucuguuuaucgaggaaggaaagaucguucauaccuccacacucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgauuaaugagacaagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggacauccaauucuauuguggucuucugugggaccagcggaacauacggcacgggguccuggccugauggcgcugaccucaaccugaugcccaucuga

SEQ ID NO: 207901 - RNA, 1410 nt, Artificial Sequence; identical to SEQ ID NO: 207760
  derived and/or modified sequence opt5 from neuraminidase__InfluenzaA__AHL97628

SEQ ID NO: 207902 - RNA, 1410 nt, Artificial Sequence; identical to SEQ ID NO: 205170
  derived and/or modified sequence opt5 from neuraminidase__InfluenzaA__AHL97640

SEQ ID NO: 207903 - RNA, 1410 nt, Artificial Sequence; identical to SEQ ID NO: 206918
  derived and/or modified sequence opt5 from neuraminidase__InfluenzaA__AHL97652

SEQ ID NO: 207904 - RNA, 1410 nt, Artificial Sequence; identical to SEQ ID NO: 206918
  derived and/or modified sequence opt5 from neuraminidase__InfluenzaA__AHL97664

SEQ ID NO: 207905 - RNA, 1410 nt, Artificial Sequence; identical to SEQ ID NO: 206399
  derived and/or modified sequence opt5 from neuraminidase__InfluenzaA__AHL97676

SEQ ID NO: 207906 - RNA, 1410 nt, Artificial Sequence; identical to SEQ ID NO: 205170
  derived and/or modified sequence opt5 from neuraminidase__InfluenzaA__AHL97688

SEQ ID NO: 207907 - RNA, 1410 nt, Artificial Sequence; identical to SEQ ID NO: 206895
  derived and/or modified sequence opt5 from neuraminidase__InfluenzaA__AHL97700

SEQ ID NO: 207908 - RNA, 1410 nt, Artificial Sequence
  derived and/or modified sequence opt5 from neuraminidase__InfluenzaA__AHL97712
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcacguccucuagccauugccuugauccuaacaaugaggaagggggacacggcgugaaagggugggccuucgacgauggaaacgacguuuggaugggccgcacaaucaaugagaccuccagacugggguaugagaccuuuaaggugaucgaaggauggagcaaccccaaaucuaagcuccagauuaaucggcaggucaucguggaucgcggcgacagauccggcuacagcgggauuuucucugucgagggaaaauccuguaucaaccggugcuuuuauguggaacugauuagaggccgcaaggaggaaacagagguucuguggaccagcaauuccaucguggucuucugugggacaucuggaacguacggcaccgggagcuggccugauggcgcugaccucaaccugaugcccauuuga

SEQ ID NO: 207909 - RNA, 1410 nt, Artificial Sequence; identical to SEQ ID NO: 206895
  derived and/or modified sequence opt5 from neuraminidase__InfluenzaA__AHL97724

SEQ ID NO: 207910 - RNA, 1410 nt, Artificial Sequence; identical to SEQ ID NO: 205170
  derived and/or modified sequence opt5 from neuraminidase__InfluenzaA__AHL97736

SEQ ID NO: 207911 - RNA, 1410 nt, Artificial Sequence
  derived and/or modified sequence opt5 from neuraminidase__InfluenzaA__AHL97760
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgaugagaacgcuaccgccagcuucauuuacaaugggcggcugguugacucuguggucuccuggagcaaggaaauccuucgcacccaggagucugagugugugugcauuaacggaacauguacgguggucaugaccgauggcuccgcuagcgggaaagccgacacaaagauccuguuuaucgaagagggaaaaauuguucauaccuccacacucucuggcagcgcgcaacacguggaagagugcuccugcuaucccagauacccuggggugcggugugucugccgcgauaacuggaagggaagcaauagacccaucguggacauuaacaucaaggaucacucuauuguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacgaucaaugagacaagcagacugggguaugagaccuuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaagaagagaccgagguucuguggacauccaauucuaucguggucuucugugggaccagcggaacauacggcacgggguccuggccugauggcgcugaccucaaccugaugcccauuuga

SEQ ID NO: 207912 - RNA, 1410 nt, Artificial Sequence
  derived and/or modified sequence opt5 from neuraminidase__InfluenzaA__AHL97772
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuguggucguguucugugggaccagcggaacauacggcacgggguccuggccugauggcgcugaccucaaccugaugcccaucuga

SEQ ID NO: 207913 - RNA, 1410 nt, Artificial Sequence; identical to SEQ ID NO: 206399
  derived and/or modified sequence opt5 from neuraminidase__InfluenzaA__AHL97784

SEQ ID NO: 207914 - RNA, 1410 nt, Artificial Sequence; identical to SEQ ID NO: 205170
  derived and/or modified sequence opt5 from neuraminidase__InfluenzaA__AHL97796

SEQ ID NO: 207915 - RNA, 1410 nt, Artificial Sequence; identical to SEQ ID NO: 205170
  derived and/or modified sequence opt5 from neuraminidase__InfluenzaA__AHL97808

SEQ ID NO: 207916 - RNA, 1410 nt, Artificial Sequence; identical to SEQ ID NO: 205170
  derived and/or modified sequence opt5 from neuraminidase__InfluenzaA__AHL97820

SEQ ID NO: 207917 - RNA, 1410 nt, Artificial Sequence
  derived and/or modified sequence opt5 from neuraminidase__InfluenzaA__AHL97832
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccgguccuggucuaagccucagugugggauuaccggauucgcccccuuuagcaaagauaacuccauccgccucucugcgggcggggacaucugggugacaagagagccuuaugucagcugcgauccggacaaguguuaccaauucgcucugggacagggcaccacacuuaauaacgugcauuccaauaacaccguucgggaucgcacgcccuauagaacacugcucaugaaugaacugggggugccuuuucaccugggaaccaagcaggucugcauugccuggucuagcuccagcugucaugacggcaaagccuggcuccacgugugcaucacaggcgaugacaagaacgcuaccgccucuuucauuuacaaugggcggcugguugauuccguggucagcuggucuaaagagauccuucgcacccaggaauccgagugugugugcauuaacggaacauguacgguggucaugaccgacggcagcgcuuccgggaaggccgauacaaaaauccuguuuaucgaggaaggaaagauuguucauaccucuacacucagcggcuccgcgcaacacguggaggaaugcagcugcuaucccagauacccuggggugcggugugucugccgcgacaauuggaagggaucuaacagacccaucguggauauuaacaucaaagaccacuccauuguuagcucuuacguguguagcggccuggucggcgacaccccgcggaagaaugauuccucuagcuccagccauugccuugacccuaacaaugaggaagggggacacggcgugaaagggugggccuucgaugacggaaacgauguuuggaugggccgcacgaucaaugagacaucuagacugggguaugagaccuuuaaggugaucgaaggaugguccaaccccaaaagcaagcuccagauuaaucggcaggucaucguggaccgcggcgauagaucuggcuacuccgggauuuucagcgucgagggaaaauccuguaucaaccggugcuuuuauguggaacugauuagaggccgcaaggaggaaaccgagguucuguggacaucuaauagcaucguggucuucugugggaccuccggaacauacggcacggggucuuggccugacggcgcugaucucaaccugaugcccauuuga

SEQ ID NO: 207918 - RNA, 1410 nt, Artificial Sequence; identical to SEQ ID NO: 205170
  derived and/or modified sequence opt5 from neuraminidase__InfluenzaA__AHL97844

SEQ ID NO: 207919 - RNA, 1410 nt, Artificial Sequence; identical to SEQ ID NO: 207911
  derived and/or modified sequence opt5 from neuraminidase__InfluenzaA__AHL97856

SEQ ID NO: 207920 - RNA, 1410 nt, Artificial Sequence; identical to SEQ ID NO: 205170
  derived and/or modified sequence opt5 from neuraminidase__InfluenzaA__AHL97868

SEQ ID NO: 207921 - RNA, 1410 nt, Artificial Sequence; identical to SEQ ID NO: 206895
  derived and/or modified sequence opt5 from neuraminidase__InfluenzaA__AHL97880

SEQ ID NO: 207922 - RNA, 1410 nt, Artificial Sequence; identical to SEQ ID NO: 205170
  derived and/or modified sequence opt5 from neuraminidase__InfluenzaA__AHL97892

SEQ ID NO: 207923 - RNA, 1410 nt, Artificial Sequence; identical to SEQ ID NO: 205170
  derived and/or modified sequence opt5 from neuraminidase__InfluenzaA__AHL97904

SEQ ID NO: 207924 - RNA, 1410 nt, Artificial Sequence; identical to SEQ ID NO: 206907
  derived and/or modified sequence opt5 from neuraminidase__InfluenzaA__AHL97916

SEQ ID NO: 207925 - RNA, 1410 nt, Artificial Sequence; identical to SEQ ID NO: 205170
  derived and/or modified sequence opt5 from neuraminidase__InfluenzaA__AHL97928

SEQ ID NO: 207926 - RNA, 1410 nt, Artificial Sequence; identical to SEQ ID NO: 207886
  derived and/or modified sequence opt5 from neuraminidase__InfluenzaA__AHL97952

SEQ ID NO: 207927 - RNA, 1410 nt, Artificial Sequence; identical to SEQ ID NO: 205170
  derived and/or modified sequence opt5 from neuraminidase__InfluenzaA__AHL97964

SEQ ID NO: 207928 - RNA, 1410 nt, Artificial Sequence; identical to SEQ ID NO: 205170
  derived and/or modified sequence opt5 from neuraminidase__InfluenzaA__AHL97976

SEQ ID NO: 207929 - RNA, 1410 nt, Artificial Sequence; identical to SEQ ID NO: 205170
  derived and/or modified sequence opt5 from neuraminidase__InfluenzaA__AHL97988

SEQ ID NO: 207930 - RNA, 1410 nt, Artificial Sequence
  derived and/or modified sequence opt5 from neuraminidase__InfluenzaA__AHL98000
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaugaaucugagugugugugcauuaacggaacauguacgguggucaugaccgauggcuccgcuagcgggaaggccgacacaaaaauccuguuuaucgaggaaggaaagauuguucacaccuccacacucucuggcagcgcgcagcacguggaggaaugcuccugcuaucccagauacccuggggugcggugugucugccgcgauaacuggaagggaagcaauagacccaucguggacauuaacaucaaagaucauucuauuguuuccagcuacguguguucuggccuggucggcgacaccccgcggaagaaagacagcuccucuagcucccacugccuugauccuaauaacgaggaagggggacauggcgugaaggggugggccuucgacgauggaaaugacguuuggaugggccgcacgaucaacgagacaagcagacugggguaugagaccuuuaaagugaucgaaggauggucuaaucccaaguccaaacuccaaauuaaccggcaggucaucguggaucgcggcgacagaagcggcuacucugggauuuucuccgucgagggaaagagcuguaucaaucggugcuuuuauguggaacugauuagaggccgcaaggaggaaaccgagguucuguggacauccaacucuaucguggucuucugugggaccagcggaacauacggcacgggguccuggccugauggcgcugaccucaaucugaugcccauuuga

SEQ ID NO: 207931 - RNA, 1410 nt, Artificial Sequence
  derived and/or modified sequence opt5 from neuraminidase__InfluenzaA__AHL98012
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagaggugcuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaaggggaccacggaguuaaaggcugggccuucgaugacgggaacgauguguggaugggacgcacgauuaaugagacaagcagacugggcuaugagaccuuuaaggucaucgaaggguggucuaaccccaaauccaagcuccagaucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggccugacggggcugaucucaaccugaugcccaucuga

SEQ ID NO: 207932 - RNA, 1410 nt, Artificial Sequence; identical to SEQ ID NO: 206907
  derived and/or modified sequence opt5 from neuraminidase__InfluenzaA__AHL98048

SEQ ID NO: 207933 - RNA, 1410 nt, Artificial Sequence; identical to SEQ ID NO: 206907
  derived and/or modified sequence opt5 from neuraminidase__InfluenzaA__AHL98060

SEQ ID NO: 207934 - RNA, 1410 nt, Artificial Sequence; identical to SEQ ID NO: 206907
  derived and/or modified sequence opt5 from neuraminidase__InfluenzaA__AHL98072

SEQ ID NO: 207935 - RNA, 1410 nt, Artificial Sequence; identical to SEQ ID NO: 205170
  derived and/or modified sequence opt5 from neuraminidase__InfluenzaA__AHL98084

SEQ ID NO: 207936 - RNA, 1410 nt, Artificial Sequence; identical to SEQ ID NO: 206907
  derived and/or modified sequence opt5 from neuraminidase__InfluenzaA__AHL98096

SEQ ID NO: 207937 - RNA, 1410 nt, Artificial Sequence; identical to SEQ ID NO: 205170
  derived and/or modified sequence opt5 from neuraminidase__InfluenzaA__AHL98119

SEQ ID NO: 207938 - RNA, 1410 nt, Artificial Sequence; identical to SEQ ID NO: 205170
  derived and/or modified sequence opt5 from neuraminidase__InfluenzaA__AHL98131

SEQ ID NO: 207939 - RNA, 1410 nt, Artificial Sequence; identical to SEQ ID NO: 205170
  derived and/or modified sequence opt5 from neuraminidase__InfluenzaA__AHL98143

SEQ ID NO: 207940 - RNA, 1410 nt, Artificial Sequence
  derived and/or modified sequence opt5 from neuraminidase__InfluenzaA__AHL98155
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaacuccaaaagcaagcuccagauuaaucggcaggucaucguggaucgcggcgacagaucuggcuacuccgggauuuucagcgucgagggaaaauccuguaucaaccggugcuuuuauguggaacugauuagaggccgcaaggaggaaaccgagguucuguggacaucuaauagcaucguggucuucugugggaccuccggaacauacggcacggggucuuggcccgauggcgcugaccucaaccugaugccuauuuga

SEQ ID NO: 207941 - RNA, 1410 nt, Artificial Sequence; identical to SEQ ID NO: 205170
  derived and/or modified sequence opt5 from neuraminidase__InfluenzaA__AHL98167

SEQ ID NO: 207942 - RNA, 1410 nt, Artificial Sequence; identical to SEQ ID NO: 205170
  derived and/or modified sequence opt5 from neuraminidase__InfluenzaA__AHL98179

SEQ ID NO: 207943 - RNA, 1410 nt, Artificial Sequence; identical to SEQ ID NO: 205170
  derived and/or modified sequence opt5 from neuraminidase__InfluenzaA__AHL98191

SEQ ID NO: 207944 - RNA, 1410 nt, Artificial Sequence; identical to SEQ ID NO: 206907
  derived and/or modified sequence opt5 from neuraminidase__InfluenzaA__AHL98215

SEQ ID NO: 207945 - RNA, 1410 nt, Artificial Sequence
  derived and/or modified sequence opt5 from neuraminidase__InfluenzaA__AHL98227
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgacaucguguaucugacaaacaccacgauugaaaaggagaucugcccuaaacccgcugaauaccggaauugguccaagccucagugugggauuaccggauucgcccccuuuucuaaagauaacagcauccgccucuccgcgggcggggacaucugggugacaagagagccuuaugucucuugcgauccggacaaguguuaccaauucgcucugggacagggcaccacacuuaauaacaugcauagcaauaacaccgugcgggaucgcacgcccuauagaacacugcucaugaaugagcuggggguuccuuuucaccugggaaccaaacaggugugcauugccugguccucuagcuccugucaugacggcaaggccuggcuccacgucugcaucacaggcgaugacaagaacgcuaccgccagcuucauuuacaaugggcggcugguggauucuguuguguccuggagcaaagaaauccuucgcacccaggagucugaaugugucugcauuaacggaacauguacgguggugaugaccgacggcuccgcuagcgggaaggccgauacaaaaauccuguuuaucgaggagggaaagauuguccauaccuccacacucucuggcagcgcgcaacacguugaagagugcuccugcuaucccagauacccuggggugcggugugugugccgcgacaacuggaagggaagcaauagacccaucgucgauauuaacaucaaagaccacucuauuguguccagcuacguuuguucuggccuggugggcgacaccccgcggaagaaugauagcuccucuagcucccauugccuugacccuaacaaugaagaagggggacacggcgucaaagggugggccuucgaugacggaaacgauguguggaugggccgcacgaucaaugagacaagcagacugggguaugagaccuuuaagguuaucgagggauggucuaaccccaaauccaagcuccagauuaaucgccaggugaucgucgaccggggcgauagaagcggcuacucugggauuuucuccguggaaggaaaaagcuguaucaaccggugcuuuuaugucgagcugauuagaggccgcaaggaagagaccgaagugcuguggacauccaauucuaucguuguguucugugggaccagcggaacauacggcacgggguccuggccugacggcgcugaucucaaccugaugcccauuuga

SEQ ID NO: 207946 - RNA, 1410 nt, Artificial Sequence; identical to SEQ ID NO: 205170
  derived and/or modified sequence opt5 from neuraminidase__InfluenzaA__AHL98239

SEQ ID NO: 207947 - RNA, 1410 nt, Artificial Sequence; identical to SEQ ID NO: 205170
  derived and/or modified sequence opt5 from neuraminidase__InfluenzaA__AHL98251

SEQ ID NO: 207948 - RNA, 1410 nt, Artificial Sequence; identical to SEQ ID NO: 206918
  derived and/or modified sequence opt5 from neuraminidase__InfluenzaA__AHL98263

SEQ ID NO: 207949 - RNA, 1410 nt, Artificial Sequence; identical to SEQ ID NO: 205170
  derived and/or modified sequence opt5 from neuraminidase__InfluenzaA__AHL98275

SEQ ID NO: 207950 - RNA, 1410 nt, Artificial Sequence; identical to SEQ ID NO: 207816
  derived and/or modified sequence opt5 from neuraminidase__InfluenzaA__AHL98287

SEQ ID NO: 207951 - RNA, 1410 nt, Artificial Sequence
  derived and/or modified sequence opt5 from neuraminidase__InfluenzaA__AHL98298
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgggagaaauauuaccgagaucguguaucugacaaacaccacgauugaaaaggagaucugcccuaaacccgcugaauaccggaauugguccaagccucaguguggaauuaccggcuucgcccccuuuucuaaagacaacagcauccgccucuccgcugggggagauaucugggugacaagagagccuuaugucucuugcgacccggauaaguguuaccaauucgcgcugggccaggggaccacacuuaauaacgugcauagcaauaacaccguucgggaccgcacgcccuauagaacacugcucaugaaugagcugggagugccuuuucaccugggcaccaagcaggucugcauugccugguccucuagcuccugucaugauggcaaagccuggcuccacgugugcaucacaggggacgauaagaacgcuaccgccagcuucauuuacaauggacggcugguugacucuguggucuccuggagcaaagaaauccuucgcacccaggagucugaaugugugugcauuaacggcacauguacgguggucaugaccgauggguccgcuagcggaaaggccgacacaaaaauccuguuuaucgaggagggcaagauuguucauaccuccacacucucugggagcgcgcaacacguggaagagugcuccugcuaucccagauacccuggagugcggugugucugccgcgauaacuggaagggcagcaauagacccaucguggacauuaacaucaaagaucacucuauuguuuccagcuacguguguucuggccuggucggggacaccccgcggaagaaugacagcuccucuagcucccauugccuugauccuaacaaugaagagggaggccacggggugaaaggaugggccuucgacgauggcaacgacguuuggauggggcgcacgaucaaugaaacaagcagacugggauaugagaccuuuaaggugaucgagggcuggucuaaccccaaauccaagcuccagauuaaucggcaggucaucguggaucgcggcgacagaagcggguacucuggaauuuucuccgucgaaggcaaaagcuguaucaaccggugcuuuuauguggagcugauuagagggcgcaaggaagagaccgaaguucuguggacauccaauucuaucguggucuucuguggaaccagcggcacauacgggacgggcuccuggccugauggagcugaccucaaccugaugcccauuuga

SEQ ID NO: 207952 - RNA, 1410 nt, Artificial Sequence; identical to SEQ ID NO: 205170
  derived and/or modified sequence opt5 from neuraminidase__InfluenzaA__AHL98310

SEQ ID NO: 207953 - RNA, 1410 nt, Artificial Sequence; identical to SEQ ID NO: 205170
  derived and/or modified sequence opt5 from neuraminidase__InfluenzaA__AHL98322

SEQ ID NO: 207954 - RNA, 1410 nt, Artificial Sequence
  derived and/or modified sequence opt5 from neuraminidase__InfluenzaA__AHL98334
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaagugguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 207955 - RNA, 1410 nt, Artificial Sequence
  derived and/or modified sequence opt5 from neuraminidase__InfluenzaA__AHL98346
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaacgagguucuguggaccuccaauucuaucguggucuucugugggacaagcggaaccuacggcacaggguccuggccugacggcgcugaucucaaccugaugcccauuuga

SEQ ID NO: 207956 - RNA, 1410 nt, Artificial Sequence; identical to SEQ ID NO: 205170
  derived and/or modified sequence opt5 from neuraminidase__InfluenzaA__AHL98357

SEQ ID NO: 207957 - RNA, 1410 nt, Artificial Sequence; identical to SEQ ID NO: 206918
  derived and/or modified sequence opt5 from neuraminidase__InfluenzaA__AHL98369

SEQ ID NO: 207958 - RNA, 1410 nt, Artificial Sequence
  derived and/or modified sequence opt5 from neuraminidase__InfluenzaA__AHL98381
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcggaccggacaaguguuaccaauucgcucugggccaggggaccacacuuaauaacaugcauagcaauaacaccgugcgggaucgcacgcccuauagaacacugcucauguccgaacugggaguuccuuuucaccugggcaccaaacaggugugcauugccuggucuagcuccagcugucaugacggcaaggccuggcuccacgucugcaucacaggggaugacaagaaugcuaccgccucuuucauuuacaacggacggcugguggauuccguugugagcuggucuaaagagauccuucgcacccaggaauccgagugugucugcauuaauggcacauguacgguggugaugaccgacgggagcgcuuccggaaaggccgauacaaaaauccuguuuaucgaggaaggcaagauuguccauaccucuacacucagcggguccgcgcaacacguugaggaaugcagcugcuaucccagauacccuggagugcggugugugugccgcgacaacuggaagggcucuaacagacccaucgucgauauuaauaucaaagaccacuccaccgugagcucuuacguuuguagcggccuggugggggauacgccgcggaagaacgacuccucuagcuccagccauugccuugacccuaauaacgaggaaggaggccacggggucaaaggaugggccuucgaugacggcaaugauguguggauggggcgcacaauuaacgagaccucuagacugggauaugagaccuuuaagguuaucgaaggcugguccaaucccaaaagcaagcuccagaucaaccgccaggugauugucgaccggggcgauagaucuggguacuccggaaucuucagcguggagggcaaauccuguauuaaucggugcuuuuaugucgaacugaucagagggcgcaaggaggaaacagaggugcuguggaccucuaacagcauuguuguguucuguggaacauccggcacguacgggaccggcucuuggccugacggagcugaucucaaucugaugcccaucuga

SEQ ID NO: 207959 - RNA, 1410 nt, Artificial Sequence
  derived and/or modified sequence opt5 from neuraminidase__InfluenzaA__AHL98393
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugugucuugcggaccggacaaguguuaccaauucgcucugggccaggggaccacacuuaauaacaugcauagcaauaacaccguccgggaucgcacgcccuauagaacacugcucaugaaugaacugggagugccuuuucaccugggcaccaagcagguuugcauugccugguccucuagcuccugucaugacggcaaagccuggcuccacgugugcaucacaggggaugacaagaacgcuaccgccagcuucauuuacaauggacggcuggucgauucugugguuuccuggagcaaagagauccuucgcacccaggaaucugagugugugugcauuaacggcacauguacggucgugaugaccgacggguccgcuagcggaaaggccgauacaaaaauccuguuuaucgaggaaggcaagauugugcauaccuccacacucucugggagcgaccaacacaucgaggaaugcuccugcuaucccagauacccuggaguccgguguguuugccgcgauaacuggaagggcagcaauagacccauuguggacaucaacauuaaagaucacucuaucguguccagcuacgucuguucuggccuggugggggacaccccgcggaagaaugacagcuccucuagcucccauugccuugauccuaacaaugaggaaggaggccacgggguuaaaggaugggcguucgacgauggcaacgacguguggauggggcgcacgaucaaugagacaagcagacugggauaugagaccuuuaaggucauugaaggcuggucuaaccccaaauccaagcuccagaucaaucgccaggugauuguugaucggggcgacagaagcggguacucuggaaucuucuccguggagggcaaaagcuguauuaaccggugcuuuuaugucgaacugaucagagggcgcaaggaggaaaccgaggugcuguggacauccaauucuauugucguguucuguggaaccagcggcacauacgggacgggcuccuggccugauggagccgaccucaaccugaugcccaucuga

SEQ ID NO: 207960 - RNA, 1410 nt, Artificial Sequence; identical to SEQ ID NO: 205170
  derived and/or modified sequence opt5 from neuraminidase__InfluenzaA__AHL98405

SEQ ID NO: 207961 - RNA, 1410 nt, Artificial Sequence; identical to SEQ ID NO: 205170
  derived and/or modified sequence opt5 from neuraminidase__InfluenzaA__AHL98417

SEQ ID NO: 207962 - RNA, 1410 nt, Artificial Sequence; identical to SEQ ID NO: 205170
  derived and/or modified sequence opt5 from neuraminidase__InfluenzaA__AHL98429

SEQ ID NO: 207963 - RNA, 1410 nt, Artificial Sequence
  derived and/or modified sequence opt5 from neuraminidase__InfluenzaA__AHL98452
augaaccccacccagaagaucauuacaaucggcagcgugugcaugacgauugggauggccaaucugauccuccaaauuggaaacaucaucuccauuuggaucucucacagcauucagcugggcaaucagucccagaucgagaccuguaaccaaucugucauuacauacgaaaauaacaccuggguuaaucagacauaugugaacaucagcaauaccaacuucgcugccgggcaguccguggucucugugaaacuugcgggaaauagcucccugugcccuguuagcggcugggcuauuuacucuaaggacaacuccgugagaaucgggagcaaaggagaugucuuugugauccgggagccguucauuucuuguagcccccucgaaugccgcacauuuuuccugacccagggcgcccuucugaaugacaagcauuccaacggcacgaucaaagauagaucuccuuaucggacccucauguccugucccauuggggagguuccuagccccuacaauucccgcuuugaaucuguggccuggagcgcuuccgccugccacgacggaaucaacuggcugacaauuggcaucagcgggccugauucuggagcugucgccgugcugaaguauaacggcaucauuaccgacacaaucaaguccuggaaaaauaacauucucagaacccaagagagcgagugugcgugcgugaaugggucuuguuucacgaucaugacagauggaccgagcgacggccaggccuccuacaagauuuuucggaucgaaaaaggcaagaucgucaaaucuguugagaugaacgcucccaauuaucauuacgaagagugcagcuguuacccugauuccagcgagauuaccugcgugugccgcgacaacuggcacgggucuaauagacccuggguguccuucaaccagaaucuggaauaucagaucggauacauuuguagcggcgucuuuggggauaacccucggcccaaugacaagacaggaucuugcggcccgguguccagcaacggggccaauggaguuaagggcuucuccuuuaaauauggcaacgggguguggaucggacgcaccaagucuauuagcuccagaaaaggcuucgagaugaucugggauccuaauggguggaccggaacagacaacaacuuuucuauuaagcaagacaucgucggcaucaaugaauggagcggguacuccggcagcuucgugcagcaucccgagcuuacgggacuggauuguauucggccuugcuucuggguugaacucauccgcggcagacccaaagagaacaccauuuggacaucuggguccagcaucucuuuuuguggagucaauuccgacaccgugggcuggagcuggcccgauggggcugagcugccuuucacaauugacaaguga

SEQ ID NO: 207964 - RNA, 1410 nt, Artificial Sequence
  derived and/or modified sequence opt5 from neuraminidase__InfluenzaA__AHL98474
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccuaauucuggagcugucgccgugcugaaguauaacggcaucauuacagauaccaucaaguccuggagaaauaacauucuccggacacaagagagcgagugugcgugcgugaaugggucuuguuucaccaucaugacggacggaccgagcgauggccaggccuccuacaaaauuuuucgcaucgaaaagggcaaaaucgucaagucuguugagaugaacgcucccaauuaucauuacgaagagugcagcuguuacccugacuccagcgagauuacaugcgugugcagagauaacuggcacgggucuaaucggcccuggguguccuucaaccagaaucuggaauaucagaucggauacauuuguagcggcgucuuuggggacaacccucgccccaaugauaaaaccggaucuugcggcccgguguccagcaacggggccaauggaguuaagggcuucuccuuuaaguauggcaacgggguguggaucggaagaacaaaaucuauuagcucccggaagggcuucgagaugaucugggacccuaacggguggaccggaaccgauaauaacuuuucuauuaaacaagacaucgucggcaucaaugaauggagcggguacuccggcagcuucgugcagcaucccgagcuuacaggacuggacuguauucgcccuugcuucuggguugaacucaucagaggccggcccaaggagaacacgauuuggaccucuggguccagcaucucuuuuuguggagucaauuccgauacagugggcuggagcuggcccgacggggcugagcugccuuucaccauugauaaauga

SEQ ID NO: 207965 - RNA, 1410 nt, Artificial Sequence
  derived and/or modified sequence opt5 from neuraminidase__InfluenzaA__AHL98485
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccauccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacaccgcggaagaaugacagcuccucuagcucccauugccuugauccuaacaaugaggaagggggacacggcgugaaagggugggccuucgacgauggaaacgacguuuggaugggccgcaccaucaaugagacgagcagacugggguaugagacauuuaaggugauugaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggaccuccaauucuauuguggucuucugugggacaagcggaaccuacggcacaggguccuggccugauggcgcugaccucaaccugaugcccaucuga

SEQ ID NO: 207966 - RNA, 1410 nt, Artificial Sequence; identical to SEQ ID NO: 206399
  derived and/or modified sequence opt5 from neuraminidase__InfluenzaA__AHL98497

SEQ ID NO: 207967 - RNA, 1410 nt, Artificial Sequence; identical to SEQ ID NO: 205170
  derived and/or modified sequence opt5 from neuraminidase__InfluenzaA__AHL98509

SEQ ID NO: 207968 - RNA, 1410 nt, Artificial Sequence; identical to SEQ ID NO: 205170
  derived and/or modified sequence opt5 from neuraminidase__InfluenzaA__AHL98521

SEQ ID NO: 207969 - RNA, 1410 nt, Artificial Sequence; identical to SEQ ID NO: 206399
  derived and/or modified sequence opt5 from neuraminidase__InfluenzaA__AHL98533

SEQ ID NO: 207970 - RNA, 1410 nt, Artificial Sequence; identical to SEQ ID NO: 205170
  derived and/or modified sequence opt5 from neuraminidase__InfluenzaA__AHL98545

SEQ ID NO: 207971 - RNA, 1410 nt, Artificial Sequence; identical to SEQ ID NO: 205170
  derived and/or modified sequence opt5 from neuraminidase__InfluenzaA__AHL98557

SEQ ID NO: 207972 - RNA, 1410 nt, Artificial Sequence; identical to SEQ ID NO: 205170
  derived and/or modified sequence opt5 from neuraminidase__InfluenzaA__AHL98569

SEQ ID NO: 207973 - RNA, 1410 nt, Artificial Sequence
  derived and/or modified sequence opt5 from neuraminidase__InfluenzaA__AHL98581
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcgggaauaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaacggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaauuggaagggaagcaacagacccaucguggauauuaauaucaaagaccacucuauuguuuccagcuacguguguucuggccuggucggcgauaccccgcggaagaacgacagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 207974 - RNA, 1410 nt, Artificial Sequence; identical to SEQ ID NO: 205170
  derived and/or modified sequence opt5 from neuraminidase__InfluenzaA__AHL98593

SEQ ID NO: 207975 - RNA, 1410 nt, Artificial Sequence; identical to SEQ ID NO: 206907
  derived and/or modified sequence opt5 from neuraminidase__InfluenzaA__AHL98605

SEQ ID NO: 207976 - RNA, 1410 nt, Artificial Sequence; identical to SEQ ID NO: 206399
  derived and/or modified sequence opt5 from neuraminidase__InfluenzaA__AHL98617

SEQ ID NO: 207977 - RNA, 1410 nt, Artificial Sequence; identical to SEQ ID NO: 206399
  derived and/or modified sequence opt5 from neuraminidase__InfluenzaA__AHL98629

SEQ ID NO: 207978 - RNA, 1410 nt, Artificial Sequence; identical to SEQ ID NO: 205170
  derived and/or modified sequence opt5 from neuraminidase__InfluenzaA__AHL98641

SEQ ID NO: 207979 - RNA, 1410 nt, Artificial Sequence; identical to SEQ ID NO: 207748
  derived and/or modified sequence opt5 from neuraminidase__InfluenzaA__AHL98653

SEQ ID NO: 207980 - RNA, 1410 nt, Artificial Sequence; identical to SEQ ID NO: 205170
  derived and/or modified sequence opt5 from neuraminidase__InfluenzaA__AHL98665

SEQ ID NO: 207981 - RNA, 1410 nt, Artificial Sequence
  derived and/or modified sequence opt5 from neuraminidase__InfluenzaA__AHL98677
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgccccacagaacacugcucaugaaugaacugggggugccuuuucaucugggaaccaagcaggucugcauugccugguccucuagcuccugucacgauggcaaagccuggcuccaugugugcaucacaggcgacgauaagaacgcuaccgccagcuucauuuauaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucacaccuccacacucucuggcaacgcgcaacacguggaggaaugcagcugcuaccccagauauccuggggugcggugugucugccgcgauaauuggaagggauccaacagacccaucguggacauuaauaucaaagaucauagcauuguuucuuccuacguguguagcggccuggucggcgacaccccgcggaagaacgacucuagcuccucuagccacugccuugauccuaauaacgaggaagggggacauggcgugaaagggugggccuucgacgauggaaaugacguuuggaugggccgcacgaucaacgagacauccagacugggguacgagaccuuuaaggugaucgaaggauggagcaaucccaaaucuaagcuccagauuaaccggcaggucaucguggaucgcggcgacagauccggcuauagcgggauuuucucugucgagggaaaauccuguaucaaucggugcuuuuacguggaacugauuagaggccgcaaggaggaaaccgagguucuguggacaagcaacuccaucguggucuucugugggaccucuggaacauauggcacggggagcuggccugauggcgcugaccucaaucugaugcccauuuga

SEQ ID NO: 207982 - RNA, 1410 nt, Artificial Sequence; identical to SEQ ID NO: 206918
  derived and/or modified sequence opt5 from neuraminidase__InfluenzaA__AHL98689

SEQ ID NO: 207983 - RNA, 1410 nt, Artificial Sequence
  derived and/or modified sequence opt5 from neuraminidase__InfluenzaA__AHL98702
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugggcauagcaacaauaccgugcgggaucgcacgcccuauagaacacugcucaugaacgaacugggaguuccuuuucaccugggcaccaaacaggugugcauugccugguccucuagcuccugucaugacggcaaggccuggcuccacgucugcaucacaggggaugacaagaaugcuaccgccagcuucauuuacaacggacggcugguggauucuguuguguccuggagcaaagagauccuucgcacccaggaaucugagugugucugcauuaauggcacauguacgguggugaugaccgacggguccgcuagcggaaaggccgauacaaaaauccuguuuaucgaggaaggcaagauuguccauaccuccacacucucugggagcgcgcaacacguugaggaaugcuccugcuaucccagauacccuggagugcggugugugugccgcgacaacuggaagggcagcaacagacccaucgucgauauuaauaucaaagaccacucuauuguguccagcuacguuuguucuggccuggugggggacaccccgcggaagaacgauagcuccucuagcucccauugccuugacccuaauaacgaggaaggaggccacggggucaaaggaugggccuucgaugacggcaaugauguguggauggggcgcacgaucaacgagacaagcagacugggauaugagaccuuuaagguuaucgaaggcuggucuaaucccaaauccaagcuccagauuaaccgccaggugaucgucgaccggggcgauagaagcggguacucuggaauuuucuccguggagggcaaaagcuguaucaaucggugcuuuuaugucgaacugauuagagggcgcaaggaggaaaccgaggugcuguggacauccaacucuaucguuguguucuguggaaccagcggcacauacgggacgggcuccuggccugacggagcugaucucaaucugaugcccauuuga

SEQ ID NO: 207984 - RNA, 1410 nt, Artificial Sequence; identical to SEQ ID NO: 206413
  derived and/or modified sequence opt5 from neuraminidase__InfluenzaA__AHL98714

SEQ ID NO: 207985 - RNA, 1410 nt, Artificial Sequence
  derived and/or modified sequence opt5 from neuraminidase__InfluenzaA__AHL98725
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcgggggaaucugggugacaagagagccuuaugucucuugcgauccggacaaguguuaccaauucgcucugggccaggggaccacacuuaauaacgugcauagcaauaacaccguucgggaucgcacgcccuauagaacacugcucaugaaugaacugggagugccuuuucaccugggcaccaagcaggucugcauugccugguccucuagcuccugucaugacggcaaagccuggcuccacgugugcaucacaggggaugacaagaacgcuaccgccagcuucauuuacaauggacggcugguugauucuguggucuccuggagcaaagagauccuucgcacccaggaaucugagugugugugcauuaacggcacauguacgguggucaugaccgacgggaacgcuuccggaaaggccgauacaaaaauccuguuuaucgaggaaggcaagauuguucauaccagcacacucuccgggucugcgcaacacguggaggaaugcagcugcuaucccagauacccuggagugcggugugucugccgcgacaauuggaagggcuccaacagacccaucguggauauuaauaucaaagaccacagcauuguuucuuccuacguguguagcggccuggucggggauaccccgcggaagaacgacucuagcuccucuagccauugccuugacccuaauaacgaggaaggaggccacggggugaaaggaugggccuucgaugacgagaaugauguuuggaugggccgcacgaucaacgagacauccagacugggguaugaaaccuuuaaggugaucgagggauggagcaaucccaaaucuaagcuccagauuaaccggcaggucaucguggaccgcggcaauagauccggcuacagcgggauuuucucugucgaaggaaaauccuguaucaaccggugcuuuuauguggagcugauuagaggccgcaaggaagagaccgagguucuguggacaagcaauuccaucguggucuucugugggaccucuggaacauacggcacggggagcuggccugauggcgcugaccucaaccugaugcccauuuga

SEQ ID NO: 207986 - RNA, 1410 nt, Artificial Sequence; identical to SEQ ID NO: 206907
  derived and/or modified sequence opt5 from neuraminidase__InfluenzaA__AHL98737

SEQ ID NO: 207987 - RNA, 1410 nt, Artificial Sequence; identical to SEQ ID NO: 206895
  derived and/or modified sequence opt5 from neuraminidase__InfluenzaA__AHL98749

SEQ ID NO: 207988 - RNA, 1410 nt, Artificial Sequence; identical to SEQ ID NO: 206907
  derived and/or modified sequence opt5 from neuraminidase__InfluenzaA__AHL98761

SEQ ID NO: 207989 - RNA, 1410 nt, Artificial Sequence
  derived and/or modified sequence opt5 from neuraminidase__InfluenzaA__AHL98773
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcgggaauaucugggugacaagagagccuuaugucucuugcgauccggacaaguguuaccaauucgcucugggacagggcaccacacuuaacaaugugcauagcaacaauaccgcccgggaucgcacgcccuauagaacacugcucaugaacgaacuggggguuccuuuucaccugggaaccaaacaggugugcauugccugguccucuagcuccugucaugacggcaaggcuuggcuccacgucugcaucacaggcgaugacaagaaugccaccgcuagcuucauuuacaacgggcggcugguggauucuguuguguccuggagcaaagagauccuucgcacccaggaaucugagugugucugcauuaacggaacauguacgguggugaugaccgacggcuccgccagcgggaaggcggauacaaaaauccuguuuaucgaggaaggaaagauuguccauaccuccacacucucuggcagcgcccaacacguugaggaaugcuccugcuaucccagauacccuggggugcggugugugugccgcgacaauuggaagggaagcaacagacccaucgucgauauuaauaucaaagaccacucuauuguguccagcuacguuuguucuggccuggugggcgauaccccgcggaagaacgacagcuccucuagcucccauugccuugacccuaauaacgaggaagggggacacggcgucaaagggugggcuuucgaugacggaaaugauguguggaugggccgcacgaucaacgagacaagcagacugggguaugagaccuuuaagguuaucgaaggauggucuaaucccaaauccaagcuccagauuaaccgccaggugaucgucgaccggggcgauagaagcggcuacucugggauuuucuccguggagggaaaaagcuguaucaaucggugcuuuuaugucgaacugauuagaggccgcaaggaggaaaccgaggugcuguggacauccaacucuaucguuguguucugugggaccagcggaacauacggcacgggguccuggccugacggcgccgaucucaaucugaugcccauuuga

SEQ ID NO: 207990 - RNA, 1410 nt, Artificial Sequence; identical to SEQ ID NO: 206927
  derived and/or modified sequence opt5 from neuraminidase__InfluenzaA__AHL98785

SEQ ID NO: 207991 - RNA, 1410 nt, Artificial Sequence
  derived and/or modified sequence opt5 from neuraminidase__InfluenzaA__AHL98797
augaaccccaaucagaagaucauuaccaucggcagcgugucccugacaauuucuacgaucugcuucuuuacccaaauugccauccucaucacaaccgucacacugcacuucaaacaguacgaguuuaacagcccuccgaauaaccagguuaugcuuugugaacccaccauuaucgagagaaauauuacagaaaucguguaucugaccaacacgaccauugagaaggaaaucugcccuaaacccgcugaguaccggaauugguccaagccucagugugggauuacaggauucgcccccuuuucuaaagacaacagcauccgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcauugccugguccucuagcuccugucaugauggcaaagccuggcuccacgugugcaucaccggcgacgauaagaacgcuaccgccagcuucauuuacaaugggcggcugguugacucuguggucuccuggagcaaagagauccuucgcacacaggaaucugagugugugugcauuaacggaacguguaccguggucaugacagauggcuccgcuagcgggaaggccgacaccaaaauccuguuuaucgaggaaggaaagauuguucauacauccacccucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaaucaaugagaccagcagaucuggguaugagaccuuuaaggugaucgaaggaugguccaaccccaaaagcaagcugcagauuaaucggcaggucaucguggaucgcggcgacagaucuggcuacuccgggauuuucagcgucgagggaaaauccuguaucaaccggugcuuuuauguggaacucauuagaggccgcaaggaggaaacagagguucuguggaccucuaauagcaucguggucuucugugggacauccggaacguacggcaccgggucuuggccugauggcgcugaccugaaccucaugcccauuuga

SEQ ID NO: 207992 - RNA, 1410 nt, Artificial Sequence; identical to SEQ ID NO: 205170
  derived and/or modified sequence opt5 from neuraminidase__InfluenzaA__AHL98809

SEQ ID NO: 207993 - RNA, 1410 nt, Artificial Sequence
  derived and/or modified sequence opt5 from neuraminidase__InfluenzaA__AHL98821
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggaucgguguuaccaauucgcucugggacagggcaccacacuuaauaacaugcauagcaauaacaccgugcgcgacagaacgcccuaucggacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcgccugguggacucuguuguguccuggagcaaggagauccuuagaacccaggaaucugagugugucugcauuaacggaacauguacgguggugaugaccgauggcuccgcuagcgggaaagccgacacaaagauccuguuuaucgaggaaggaaaaauuguccauaccuccacacucucuggcagcgcgcaacacguugaggaaugcuccugcuauccccgguacccuggggugcgcugugugugcagagauaacuggaagggaagcaaucggcccaucgucgacauuaacaucaaggaucacucuauuguguccagcuacguuuguucuggccuggugggcgacaccccgcgcaaaaaugacagcuccucuagcucccauugccuugauccuaacaaugaggaagggggacacggcgucaaggggugggccuucgacgauggaaacgacguguggaugggcagaacgaucaaugagacaagccggcugggguaugagaccuuuaaaguuaucgaaggauggucuaaccccaaguccaaacuccagauuaaucgccaggugaucgucgauagaggcgaccggagcggcuacucugggauuuucuccguggagggaaagagcuguaucaacagaugcuuuuaugucgaacugauucgcggccggaaagaggaaaccgaggugcuguggacauccaauucuaucguuguguucugugggaccagcggaacauacggcacgggguccuggccugauggcgcugaccucaaccugaugcccauuuga

SEQ ID NO: 207994 - RNA, 1410 nt, Artificial Sequence; identical to SEQ ID NO: 205170
  derived and/or modified sequence opt5 from neuraminidase__InfluenzaA__AHL98833

SEQ ID NO: 207995 - RNA, 1410 nt, Artificial Sequence
  derived and/or modified sequence opt5 from neuraminidase__InfluenzaA__AHL98845
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugauuaacacaaccaucgagaaggaaauuugcccuaaacccgcugaguaccggaauugguccaagccucagugugggaucacgggauucgcccccuuuucuaaagacaacagcauccgccucuccgcgggcggggauauuugggugaccagagagccuuaugucucuugcggaccggacaaguguuaccaauucgcucugggccaggggacaacccuuaauaacaugcauagcaauaacacagugcgggaucgcacccccuauagaacgcugcucaugaaugaacugggaguuccuuuucaccugggcacaaaacaggugugcaucgccugguccucuagcuccugucaugacggcaaggccuggcuccacgucugcauuaccggggaugacaagaacgcuacagccagcuucaucuacaauggacggcugguggauucuguuguguccuggagcaaagagauucuucgcacccaggaaucugagugugucugcaucaacggcaccuguacaguggugaugacggacggguccgcuagcggaaaggccgauaccaaaauccuguuuauugaggaaggcaagaucguccauacauccacccucucugggagcgcgcaacacguugaggaaugcuccugcuaucccagauacccuggagugcggugugugugccgcgacaacuggaagggcagcaauagacccauugucgauaucaacauuaaagaccacucuaucguguccagcuacguuuguucuggccuggugggggauacaccgcggaagaaugacagcuccucuagcucccauugccuugacccuaacaaugaggaaggaggccacggggucaaaggaugggccuucgaugacggcaacgauguguggauggggcgcaccaucaaugagacgagcagacugggauaugagacauuuaagguuauugaaggcuggucuaaccccaaauccaagcuccagaucaaucgccaggugauugucgaccggggcgauagaagcggguacucuggaaucuucuccguggagggcaaaagcuguauuaaccggugcuuuuaugucgaacugaucagagggcgcaaggaggaaaccgaggugcuguggaccuccaauucuauuguuguguucuguggaacaagcggcaccuacgggacaggcuccuggccugacggagcugaucucaaccugaugcccaucuga

SEQ ID NO: 207996 - RNA, 1410 nt, Artificial Sequence; identical to SEQ ID NO: 206907
  derived and/or modified sequence opt5 from neuraminidase__InfluenzaA__AHL98857

SEQ ID NO: 207997 - RNA, 1410 nt, Artificial Sequence; identical to SEQ ID NO: 206907
  derived and/or modified sequence opt5 from neuraminidase__InfluenzaA__AHL98869

SEQ ID NO: 207998 - RNA, 1410 nt, Artificial Sequence; identical to SEQ ID NO: 205170
  derived and/or modified sequence opt5 from neuraminidase__InfluenzaA__AHL98881

SEQ ID NO: 207999 - RNA, 1410 nt, Artificial Sequence
  derived and/or modified sequence opt5 from neuraminidase__InfluenzaA__AHL98893
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaagguguucgaaggauggucuaaucccaaauccaagcuccagaucaaccggcaggucauuguggaccgcggcgauagaagcggcuacucugggaucuuuuccgucgagggaaaaagcuguauuaaucggugcuucuauguggaacugaucagaggccgcaaggaggaaaccgagguucuguggacauccaacucuauuguggucuucugugggaccagcggaacauacggcacgggguccuggccugacggcgcugaucucaaucugaugcccaucuga

SEQ ID NO: 208000 - RNA, 1410 nt, Artificial Sequence; identical to SEQ ID NO: 206895
  derived and/or modified sequence opt5 from neuraminidase__InfluenzaA__AHL98905

SEQ ID NO: 208001 - RNA, 1410 nt, Artificial Sequence; identical to SEQ ID NO: 205170
  derived and/or modified sequence opt5 from neuraminidase__InfluenzaA__AHL98916

SEQ ID NO: 208002 - RNA, 1410 nt, Artificial Sequence; identical to SEQ ID NO: 206918
  derived and/or modified sequence opt5 from neuraminidase__InfluenzaA__AHL98928

SEQ ID NO: 208003 - RNA, 1410 nt, Artificial Sequence; identical to SEQ ID NO: 205170
  derived and/or modified sequence opt5 from neuraminidase__InfluenzaA__AHL98940

SEQ ID NO: 208004 - RNA, 1410 nt, Artificial Sequence; identical to SEQ ID NO: 205170
  derived and/or modified sequence opt5 from neuraminidase__InfluenzaA__AHL98952

SEQ ID NO: 208005 - RNA, 1410 nt, Artificial Sequence; identical to SEQ ID NO: 206895
  derived and/or modified sequence opt5 from neuraminidase__InfluenzaA__AHL98964

SEQ ID NO: 208006 - RNA, 1410 nt, Artificial Sequence
  derived and/or modified sequence opt5 from neuraminidase__InfluenzaA__AHL98976
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuguggagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucgcuuccuggagcaaagaggugcuucgcacccaggaaucugagugugugugcauuaacggaacaugugccgucguuaugacggauggcuccgcgagcgggaaggccgacaccaaaauccuguuuauugaggaaggaaagaucgugcauacauccacccucucuggcagcgcucaacacguggaggaaugcuccugcuaucccagauacccugggguccggugugugugccgcgauaacuggaagggaagcaauagacccaucguugacauuaacaucaaagaucacucuauuguguccagcuacgucuguucuggccuggugggcgacacaccgcggaagaaugacagcuccucuagcucccauugccuugauccuaacaaugaggaagggggacacggcguuaaagggugggccuucgacgauggaaacgacguguggaugggccgcaccaucaaugagacgagcagacugggguaugagacauuuaaggucauugaaggauggucuaaccccaaauccaagcuccagaucaaucgccaggugaucgucgaucggggcgacagaagcggcuacucugggauuuucuccguggagggaaaaagcuguaucaaccggugcuuuuauguugaacugauuagaggccgcaaggaggaaaccgaggugcuguggaccuccaauucuaucgucguguucugugggacaagcggaaccuacggcacaggguccuggccugauggcgcugaccucaaccugaugcccauuuga

SEQ ID NO: 208007 - RNA, 1410 nt, Artificial Sequence; identical to SEQ ID NO: 206895
  derived and/or modified sequence opt5 from neuraminidase__InfluenzaA__AHL98988

SEQ ID NO: 208008 - RNA, 1410 nt, Artificial Sequence; identical to SEQ ID NO: 205170
  derived and/or modified sequence opt5 from neuraminidase__InfluenzaA__AHL99000

SEQ ID NO: 208009 - RNA, 1410 nt, Artificial Sequence; identical to SEQ ID NO: 205170
  derived and/or modified sequence opt5 from neuraminidase__InfluenzaA__AHL99012

SEQ ID NO: 208010 - RNA, 1410 nt, Artificial Sequence
  derived and/or modified sequence opt5 from neuraminidase__InfluenzaA__AHL99024
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcgguguaucugccgcgauaacuggaagggaagcaauagacccauugucgacaucaacauuaaagaucacucuaucguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuauugaaggauggucuaaccccaaauccaagcuccagaucaaucgccaggugauugucgaucggggcgacagaagcggcuacucugggaucuucuccguggagggaaaaagcuguauuaaccggugcuuuuaugucgaacugaucagaggccgcaaggaggaaaccgaggugcuguggacauccaauucuauuguuguguucugugggaccagcggaacauacggcacgggguccuggccugauggcgcugaccucaaccugaugcccaucuga

SEQ ID NO: 208011 - RNA, 1410 nt, Artificial Sequence; identical to SEQ ID NO: 206388
  derived and/or modified sequence opt5 from neuraminidase__InfluenzaA__AHL99036

SEQ ID NO: 208012 - RNA, 1410 nt, Artificial Sequence; identical to SEQ ID NO: 207810
  derived and/or modified sequence opt5 from neuraminidase__InfluenzaA__AHL99048

SEQ ID NO: 208013 - RNA, 1410 nt, Artificial Sequence; identical to SEQ ID NO: 205170
  derived and/or modified sequence opt5 from neuraminidase__InfluenzaA__AHL99060

SEQ ID NO: 208014 - RNA, 1410 nt, Artificial Sequence
  derived and/or modified sequence opt5 from neuraminidase__InfluenzaA__AHL99072
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaugaaagaucacucuaucguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgauuaaugagacaagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggacauccaauucuauuguggucuucugugggaccagcggaacauacggcacgggguccuggccugauggcgcugaccucaaccugaugcccaucuga

SEQ ID NO: 208015 - RNA, 1410 nt, Artificial Sequence
  derived and/or modified sequence opt5 from neuraminidase__InfluenzaA__AHL99084
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggaucgguguuaccaauucgcucugggacagggcaccacacuuaauaacaugcauagcaauaacaccgugcgcgacagaacgcccuaucggacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcgccugguggacucuguuguguccuggagcaaggagauccuuagaacccaggaaucugagugugucugcauuaacggaacauguacgguggugaugaccgauggcuccgcuagcgggaaagccgacacaaagauccuguuuaucgaggaaggaaaaauuguccauaccuccacacucucuggcagcgcgcaacacguugaggaaugcuccugcuauccccgguacccuggggugcgcugugugugcagagauaacuggaagggaagcaaucggcccaucgucgacauuaacaucaaggaucacaauauugugucuuccuacguuuguagcggccuggugggcgacaccccgcgcaaaaacgacucuagcuccucuagccauugccuugauccuaauaacgaggaagggggacacggcgucaaggggugggccuucgacgauggaaaugacguguggaugggcagaacgaucaacgagacaucccggcugggguaugagaccuuuaaaguuaucgaaggauggagcaaucccaagucuaaacuccagauuaaccgccaggugaucgucgauagaggcgaccgguccggcuacagcgggauuuucucuguggagggaaaguccuguaucaauagaugcuuuuaugucgaacugauucgcggccggaaagaggaaaccgaggugcuguggacaagcaacuccaucguuguguucugugggaccucuggaacauacggcacggggagcuggccugauggcgcugaccucaaucugaugcccauuuga

SEQ ID NO: 208016 - RNA, 1410 nt, Artificial Sequence; identical to SEQ ID NO: 205170
  derived and/or modified sequence opt5 from neuraminidase__InfluenzaA__AHL99096

SEQ ID NO: 208017 - RNA, 1410 nt, Artificial Sequence; identical to SEQ ID NO: 205170
  derived and/or modified sequence opt5 from neuraminidase__InfluenzaA__AHL99108

SEQ ID NO: 208018 - RNA, 1410 nt, Artificial Sequence; identical to SEQ ID NO: 205170
  derived and/or modified sequence opt5 from neuraminidase__InfluenzaA__AHL99120

SEQ ID NO: 208019 - RNA, 1410 nt, Artificial Sequence; identical to SEQ ID NO: 205170
  derived and/or modified sequence opt5 from neuraminidase__InfluenzaA__AHL99132

SEQ ID NO: 208020 - RNA, 1410 nt, Artificial Sequence
  derived and/or modified sequence opt5 from neuraminidase__InfluenzaA__AHL99144
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaagaauuguucauaccuccacacucucuggcagcgcgcaacacguggaggaaugcuccugcuauccccgguacccuggggugcgcugugucugcagagauaacuggaagggaagcaaucggcccaucguggacauuaacaucaaggaucacucuauuguuuccagcuacguguguucuggccuggucggcgacaccccgcgcaaaaaugacagcuccucuagcucccauugccuugauccuaacaaugaggaagggggacacggcgugaaggggugggccuucgacgauggaaacgacguuuggaugggcagaacgaucaaugagacaagccggcugggguaugagaccuuuaaagugaucgaaggauggucuaaccccaaguccaaacuccagauuaaucgccaggucaucguggauagaggcgaccggagcggcuacucugggauuuucuccgucgagggaaagagcuguaucaacagaugcuuuuauguggaacugauucgcggccggaaagaggaaaccgagguucuguggacauccaauucuaucguggucuucugugggaccagcggaacauacggcacgggguccuggccugauggcgcugaccucaaccugaugcccauuuga

SEQ ID NO: 208021 - RNA, 1410 nt, Artificial Sequence; identical to SEQ ID NO: 205170
  derived and/or modified sequence opt5 from neuraminidase__InfluenzaA__AHL99156

SEQ ID NO: 208022 - RNA, 1410 nt, Artificial Sequence
  derived and/or modified sequence opt5 from neuraminidase__InfluenzaA__AHL99168
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaccacagaaauuguguaucugaccaacacgaccaucgagaaggaaauuugcccuaaacccgcugaguaccggaauugguccaagccucagugugggaucacaggauucgcccccuuuucuaaagacaacagcauucgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcaucgccugguccucuagcuccugucaugauggcaaagccuggcuccacgugugcauuaccggcgacgauaagaacgcuaccgccagcuucaucuacaaugggcggcugguugacucuguggucuccuggagcaaagagauucuucgcacacaggaaucugagugugugugcaucaacggaacguguaccguggucaugacagauggcuccgcuagcgggaaggccgacaccaaaauucuguuuaucgaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 208023 - RNA, 1410 nt, Artificial Sequence; identical to SEQ ID NO: 205170
  derived and/or modified sequence opt5 from neuraminidase__InfluenzaA__AHL99180

SEQ ID NO: 208024 - RNA, 1410 nt, Artificial Sequence; identical to SEQ ID NO: 206034
  derived and/or modified sequence opt5 from neuraminidase__InfluenzaA__AHL99204

SEQ ID NO: 208025 - RNA, 1410 nt, Artificial Sequence
  derived and/or modified sequence opt5 from neuraminidase__InfluenzaA__AHL99216
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgguggagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuaucgacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaagaaggagaccgaaguucuguggacauccaauucuaucguggucuucugugggaccagcggaacauacggcacgggguccuggccugauggcgcugaccucaaccugaugcccauuuga

SEQ ID NO: 208026 - RNA, 1410 nt, Artificial Sequence; identical to SEQ ID NO: 205170
  derived and/or modified sequence opt5 from neuraminidase__InfluenzaA__AHL99228

SEQ ID NO: 208027 - RNA, 1410 nt, Artificial Sequence; identical to SEQ ID NO: 205170
  derived and/or modified sequence opt5 from neuraminidase__InfluenzaA__AHL99240

SEQ ID NO: 208028 - RNA, 1410 nt, Artificial Sequence; identical to SEQ ID NO: 205170
  derived and/or modified sequence opt5 from neuraminidase__InfluenzaA__AHL99252

SEQ ID NO: 208029 - RNA, 1410 nt, Artificial Sequence; identical to SEQ ID NO: 205170
  derived and/or modified sequence opt5 from neuraminidase__InfluenzaA__AHL99264

SEQ ID NO: 208030 - RNA, 1410 nt, Artificial Sequence; identical to SEQ ID NO: 205170
  derived and/or modified sequence opt5 from neuraminidase__InfluenzaA__AHL99276

SEQ ID NO: 208031 - RNA, 1410 nt, Artificial Sequence; identical to SEQ ID NO: 206907
  derived and/or modified sequence opt5 from neuraminidase__InfluenzaA__AHL99288

SEQ ID NO: 208032 - RNA, 1410 nt, Artificial Sequence; identical to SEQ ID NO: 207810
  derived and/or modified sequence opt5 from neuraminidase__InfluenzaA__AHL99300

SEQ ID NO: 208033 - RNA, 1410 nt, Artificial Sequence; identical to SEQ ID NO: 205170
  derived and/or modified sequence opt5 from neuraminidase__InfluenzaA__AHL99312

SEQ ID NO: 208034 - RNA, 1410 nt, Artificial Sequence
  derived and/or modified sequence opt5 from neuraminidase__InfluenzaA__AHL99324
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuauucuuugugaacccacaaucauugagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauccgccucuccgcgggcggggauauuugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcaucgccugguccucuagcuccugucaugauggcaaagccuggcuccacgugugcauuacaggcgacgauaagaacgcuaccgccagcuucaucuacaaugggaaacugguugacucuguggucuccuggagcaaggagauucuucggacccaggaaucugagugugugugcaucaacggaacauguacgguggucaugaccgauggcuccgcuagcgggaaagccgacacaaagauccuguuuauugaggaaggaaagaucguucauaccuccacacucucuggcagcgcgcaacacguggaggaaugcuccugcuauccccgcuacccuggggugagaugugucugccgggauaacuggaaaggaagcaaucgccccauuguggacaucaacauuaaggaucacucuaucguuuccagcuacguguguucuggccuggucggcgacaccccgcggaaaaaugacagcuccucuagcucccauugccuugauccuaacaaugaggaagggggacacggcgugaaggggugggccuucgacgauggaaacgacguuuggaugggcagaacgaucaaugagacaagccgccugggguaugagaccuuuaaagugauugaaggauggucuaaccccaaguccaaacuccagaucaauagacaggucauuguggaucggggcgaccgcagcggcuacucugggaucuucuccgucgagggaaagagcuguauuaacagaugcuuuuauguggaacugauccggggcagaaaggaggaaaccgagguucuguggacauccaauucuauuguggucuucugugggaccagcggaacauacggcacgggguccuggccugauggcgcugaccucaaccugaugcccaucuga

SEQ ID NO: 208035 - RNA, 1410 nt, Artificial Sequence; identical to SEQ ID NO: 206413
  derived and/or modified sequence opt5 from neuraminidase__InfluenzaA__AHL99348

SEQ ID NO: 208036 - RNA, 1410 nt, Artificial Sequence; identical to SEQ ID NO: 206413
  derived and/or modified sequence opt5 from neuraminidase__InfluenzaA__AHL99359

SEQ ID NO: 208037 - RNA, 1410 nt, Artificial Sequence
  derived and/or modified sequence opt5 from neuraminidase__InfluenzaA__AHL99370
augaaccccaaucagaagaucauuaccaucggcagcgugucccugacaauuacgaccaucugcuucuuuaugcaaauugccauccucaucacaaccgucacacugcacuucaaacaguacgaguuuaacucuccuccgaauaaccagaugaugcuuugugaacccaccauuaucgagagaaauauuacagaaaucguuuaucugaccaacacgaccauugagaaggaaaucugcccuaaacccgcugaguaccggaauuggagcaagccucagugugggauuacaggauucgcccccuuuuccaaagacaacucuauccgccucagcgcgggcggggauaucugggugaccagagagccuuauguguccugcgacccggauaaguguuaccaauucgcucugggacagggcacaacccuuaauaacguccauucuaauaacacggugcgggaccgcacacccuauagaacccugcucaugaaugaacuggggguuccuuuucaccugggaacaaaacaggugugcauugccuggagcuccagcucuugucaugauggcaaggccuggcuccacgucugcaucaccggcgacgauaagaacgcuaccgccuccuucauuuacaaugggcggcugguggacagcguugugucuugguccaaagagauccuucgcacacaggaaagcgagugugucugcauuaacggaacguguaccguggugaugacagauggcucugcuuccgggaaggccgacaccaaaauccuguuuaucgaggaaggaaagauuguccauacaagcacccucuccggcucugcgcaacacguugaggaaugcagcugcuaucccagauacccuggggugcggugugugugccgcgauaacuggaagggauccaauagacccaucgucgacauuaacaucaaagaucacagcauugugucuuccuacguuuguagcggccuggugggcgacacgccgcggaagaaugacucuagcuccucuagccauugccuugauccuaacaaugaggaagggggacacggcgucaaagggugggccuucgacgauggaaacgacguguggaugggccgcacaaucaaugagaccuccagacugggguaugagaccuuuaagguuaucgaaggauggagcaaccccaaaucuaagcuccagauuaaucgccaggugaucgucgaucggggcgacagauccggcuacagcgggauuuucucuguggagggaaaauccuguaucaaccggugcuuuuaugucgaacugauuagaggccgcaaggaggaaacagaggugcuguggaccagcaauuccaucguuguguucugugggacaucuggaacguacggcaccgggagcuggccugauggcgcugaccucaaccugaugcccauuuga

SEQ ID NO: 208038 - RNA, 1410 nt, Artificial Sequence; identical to SEQ ID NO: 205170
  derived and/or modified sequence opt5 from neuraminidase__InfluenzaA__AHL99393

SEQ ID NO: 208039 - RNA, 1410 nt, Artificial Sequence; identical to SEQ ID NO: 205170
  derived and/or modified sequence opt5 from neuraminidase__InfluenzaA__AHL99417

SEQ ID NO: 208040 - RNA, 1410 nt, Artificial Sequence; identical to SEQ ID NO: 205170
  derived and/or modified sequence opt5 from neuraminidase__InfluenzaA__AHL99429

SEQ ID NO: 208041 - RNA, 1410 nt, Artificial Sequence; identical to SEQ ID NO: 205170
  derived and/or modified sequence opt5 from neuraminidase__InfluenzaA__AHL99441

SEQ ID NO: 208042 - RNA, 1410 nt, Artificial Sequence; identical to SEQ ID NO: 205170
  derived and/or modified sequence opt5 from neuraminidase__InfluenzaA__AHL99453

SEQ ID NO: 208043 - RNA, 1410 nt, Artificial Sequence; identical to SEQ ID NO: 205170
  derived and/or modified sequence opt5 from neuraminidase__InfluenzaA__AHL99477

SEQ ID NO: 208044 - RNA, 1410 nt, Artificial Sequence; identical to SEQ ID NO: 207810
  derived and/or modified sequence opt5 from neuraminidase__InfluenzaA__AHL99489

SEQ ID NO: 208045 - RNA, 1410 nt, Artificial Sequence
  derived and/or modified sequence opt5 from neuraminidase__InfluenzaA__AHL99501
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuaccguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 208046 - RNA, 1410 nt, Artificial Sequence; identical to SEQ ID NO: 205170
  derived and/or modified sequence opt5 from neuraminidase__InfluenzaA__AHL99525

SEQ ID NO: 208047 - RNA, 1410 nt, Artificial Sequence
  derived and/or modified sequence opt5 from neuraminidase__InfluenzaA__AHL99537
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacguccuauagaacacugcucaugaaugaacugggggugcccuuucaccugggaaccaagcaggucugcauugccuggucuagcuccagcugucaugauggcaaagccuggcuccacgugugcaucacaggcgacgauaagaacgcuaccgccucuuucauuuacaaugggcggcugguugacuccguggucagcuggucuaaagagauccuucgcacccaggaauccgagugugugugcauuaacggaacauguacgguggucaugaccgauggcagcgcuuccgggaaggccgacacaaaaauccuguuuaucgaggaaggaaagauuguucauaccucuacacucagcggcuccgcgcaacacguggaggaaugcagcugcuauccuagauaccccggggugcggugugucugccgcgauaacuggaagggaucuaauagaccuaucguggacauuaacaucaaagaucacuccauuguuagcucuuacguguguagcggccuggucggcgacacgccccggaagaaugacuccucuagcuccagccauugccuugauccgaacaaugaggaagggggacacggcgugaaagggugggccuucgacgauggaaacgacguuuggaugggccgcaccaucaaugagacaucuagacugggguaugagaccuuuaaggugaucgaaggaugguccaacccuaaaagcaagcuccagauuaaucggcaggucaucguggaucgcggcgacagaucuggcuacuccgggauuuucagcgucgagggaaaauccuguaucaaccggugcuuuuauguggaacugauuagaggccgcaaggaggaaaccgagguucuguggacaucuaauagcaucguggucuucugugggaccuccggaacauacggcacggggucuuggcccgauggcgcugaccucaaccugaugccuauuuga

SEQ ID NO: 208048 - RNA, 1410 nt, Artificial Sequence; identical to SEQ ID NO: 206907
  derived and/or modified sequence opt5 from neuraminidase__InfluenzaA__AHL99549

SEQ ID NO: 208049 - RNA, 1410 nt, Artificial Sequence; identical to SEQ ID NO: 205170
  derived and/or modified sequence opt5 from neuraminidase__InfluenzaA__AHL99561

SEQ ID NO: 208050 - RNA, 1410 nt, Artificial Sequence
  derived and/or modified sequence opt5 from neuraminidase__InfluenzaA__AHL99573
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgggggagaaggaaauuugcccuaaacccgcugaguaccggaauugguccaagccucaguguggaaucaccggcuucgcccccuuuucuaaagacaacagcauucgccucuccgcugggggagauaucugggugacaagagagccuuaugucucuugcgacccggauaaguguuaccaauucgcgcugggccaggggaccacacuuaauaacgugcauagcaauaacaccguucgggaccgcacgcccuauagaacacugcucaugaaugaacugggagugccuuuucaccugggcaccaagcaggucugcaucgccugguccucuagcuccugucaugauggcaaagccuggcuccacgugugcauuacaggggacgauaagaacgcuaccgccagcuucaucuacaauggacggcugguugacucuguggucuccuggagcaaagagauucuucgcacccaggaaucugagugugugugcaucaacggcacauguacgguggucaugaccgauggguccgcuagcggaaaggccgacacaaaaauucuguuuaucgaggaaggcaagaucguucauaccuccacacucucugggagcgcgcaacacguggaggaaugcuccugcuaucccagauacccuggagugcggugugucugccgcgauaacuggaagggcagcaauagacccauuaucgacauuaacaucaaagaucacucuauuguguccagcuacguuuguucuggccuggugggggacaccccgcggaagaaugacagcuccucuagcucccauugccuugauccuaacaaugaggaaggaggccacggggucaaaggaugggccuucgacgauggcaacgacguguggauggggcgcacgaucaaugagacaagcagacugggauaugagaccuuuaagguuaucgaaggcuggucuaaccccaaauccaagcuccagauuaaucgccaggugaucgucgauaaaggcgaccggagcggguacucuggaauuuucuccguggagggcaagagcuguaucaacagaugcuuuuaugucgaacugauucgggggagaaaggaggaaaccgaggugcuguggacauccaauucuaucguuguguucuguggaaccagcggcacauacgggacgggcuccuggccugauggagcugaccucaaccugaugcccauuuga

SEQ ID NO: 208051 - RNA, 1410 nt, Artificial Sequence
  derived and/or modified sequence opt5 from neuraminidase__InfluenzaA__AHL99585
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccgcccgggaccgcacgcccuauagaacacugcucaugaaugaacuggggguuccuuuucaccugggaaccaaacaggugugcauugccugguccucuagcuccugucaugauggcaaggcuuggcuccacgucugcaucacaggcgacgauaagaacgccaccgcuagcuucauuuacaaugggcggcugguggacucuguuguguccuggagcaaagagauccuucgcacccaggaaucugagugugucugcauuaacggaacauguacgguggugaugaccgauggcuccgccagcgggaaggcggacacaaaaauccuguuuaucgaggaaggaaagauuguccauaccuccacacucucuggcagcgcccaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuuaacccuaauaacgaggaagggggacacggcgucaaagggugggcuuucgaugacggaaaugauguguggaugggccgcacgaucaacgagacaagcagacugggguaugagaccuuuaagguuaucgaaggauggucuaaucccaaauccaagcuccagauuaaccgccaggugaucgucgaccggggcgauagaagcggcuacucugggauuuucuccguggagggaaaaagcuguaucaaucggugcuuuuaugucgaacugauuagaggccgcaaggaggaaaccgaggugcuguggacauccaacucuaucguuguguucugugggaccagcggaacauacggcacgggguccuggccugacggcgccgaucucaaucugaugcccauuuga

SEQ ID NO: 208052 - RNA, 1410 nt, Artificial Sequence
  derived and/or modified sequence opt5 from neuraminidase__InfluenzaA__AHL99597
augaaccccaaucagaagaucauuaccaucggcagcgugugcaugacaauugggauggccaaccugauccuccaaauuggaaauaucaucuccauuuggaucucucacagcauucaggucggcaaccagucccagaucgagacguguaaucaaucuguuauuaccuacgaaaacaauacaugggugaaccagaccuaugugaauaucagcaacacaaauuucgcugucgggcaguccgugguuucugugaaacuggccggaaacagcucccuuugcccugucagcggcugggcgauuuacucuaaggacaauuccgugagaaucgggagcaaaggagauguuuuugugauccgggagccguucauuucuuguagcccccuggaaugccgcaccuuuuuccucacacagggcgcucugcuuaacgacaagcauuccaauggcaccaucaaagauagaucuccuuaucggacgcugauguccugucccauuggggaggucccuagccccuacaacucccgcuuugaaucuguggccuggagcgccuccgcuugccacgacggaaucaacuggcucaccauuggcaucagcgggccugauucuggagccguggcuguccugaaguauaauggcaucauuacagacaccaucaaguccuggagaaacgauauucugcggacacaagagagcgagugugccugcguuaaugggucuuguuucaccaucaugacggacggaccgagcgauggccaggcguccuacaaaauuuuucgcaucgaaaagggcaaaaucgugaagucuguggagaugaacgcccccaauuaucauuacgaagagugcagcuguuacccugacuccagcgagauuacaugcgucugcagagauaacuggcacgggucuaaucggcccuggguguccuucaaccagaaucucgaauaucagaucggauacauuuguagcggcaucuuuggggacaacccucgccccaaugauaaaaccggaucuugcggcccgguuuccagcaacggggcuaauggagugaagggcuucuccuuuaaguauggcaacggggucuggauuggaagaacaaaaucuaucagcucccggaagggcuucgagaugauuugggacccuaauggguggaccggaaccgacaacaacuuuucuaucaaacaagauaucgugggcauuaaugaauggagcggguacuccggcagcuucguucagcaucccgagcugacaggacuugacuguauccgcccuugcuucuggguggaacugauuagaggccggcccaaggagaacacgaucuggaccucuggguccagcauuucuuuuuguggagucaauuccgauacagugggcuggagcuggcccgacggggccgagcucccuuucaccaucgauaaauga

SEQ ID NO: 208053 - RNA, 1410 nt, Artificial Sequence
  derived and/or modified sequence opt5 from neuraminidase__InfluenzaA__AHL99608
augaaccccaaucagaagaucauuaccaucggcagcgugucccugacaauuucuacgaucugcgucuucaugcaaauugccauccucaucaccacaguuacccugcacuuuaaacaguacgaguucaacagcccuccgaauaaccaggugaugcuuugugaacccacaauuaucgagagaaauauuaccgaaaucguguaucugacaaacaccacgauugagaaggaaaucugcccuaaacccgcugaguaccggaauugguccaagccucagugugggauuaccggauuugcccccuucucuaaagacaacagcauccgccucuccgcgggcggggauaucugggucacaagagagccuuaugugucuugcgacccggauaaguguuaccaauuugcucugggacagggcaccacacuuaauaacguucauagcaauaacaccgugcgggaccgcacgcccuauagaacacugcucaugaaugaacugggggucccuuuccaccugggaaccaaacaggugugcauugccugguccuccucuuccugucaugauggcaaggccuggcuccacguuugcaucacaggcgacgauaagaacgcuaccgccagcuuuauuuacaaugggcggcugguggacucugucguguccuggagcaaagagauccuucgcacccaggaaucugagugugugugcauuaacggaacauguacggucguuaugaccgauggcuccgcuagcgggaaggccgacacaaaaauccuguucaucgaggaaggaaagauugugcauaccuccacacucucuggcagcgcgcaacacguggaggaaugcuccugcuaucccagauacccugggguccggugugugugccgcgauaacuggaagggaagcaauagacccaucguugacauuaacaucaaagaucacucuauuguguccagcuacgucuguucuggccuggugggcgacaccccgcggaagaaugacagcuccucuagcucccauugccuugauccuaacaaugaggaagggggacacggcguuaaagggugggccuuugacgauggaaacgacguguggaugggccgcacgaucaaugagacaagcagacugggguaugagaccuucaaggucaucgaaggauggucuaaccccaaauccaagcuccagauuaaucgccaggugaucgucgaucggggcgacagaagcggcuacucugggauuuuuagcguggagggaaaaagcuguaucaaccggugcuucuauguugaacugauuagaggccgcaaggaggaaaccgaggugcuguggacauccaauucuaucgucguguuuugugggaccagcggaacauacggcacgggguccuggccugauggcgcugaccucaaccugaugcccauuuga

SEQ ID NO: 208054 - RNA, 1410 nt, Artificial Sequence
  derived and/or modified sequence opt5 from neuraminidase__InfluenzaA__AHL99620
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggaaacugguugacucuguggucuccuggagcaaggagauccuucggacccaggaaucugagugugugugcauuaacggaacauguacgguggucaugaccgauggcuccgcuagcgggaaagccgacacaaagauccuguuuaucgaggaaggaaagauuguucauaccuccacacucucuggcagcgcgcaacacguggaggaaugcuccugcuauccccgcuacccuggggugagaugugucugccgggauaacuggaaaggaagcaaucgccccaucguggacauuaacaucaaggaucacucuauuguuuccagcuacguguguucuggccuggucggcgacaccccgcggaaaaaugacagcuccucuagcucccauugccuugauccuaacaaugaggaagggggacacggcgugaaggggugggccuucgacgauggaaacgacguuuggaugggcagaacgaucaaugagacaagccgccugggguaugagaccuuuaaagugaucgaaggauggucuaaccccaaguccaaacuccagauuaauagacaggucaucguggaucggggcgaccgcagcggcuacucugggauuuucuccgucgagggaaagagcuguaucaacagaugcuuuuauguggaacugauucggggcagaaaggaggaaaccgagguucuguggacauccaauucuaucguggucuucugugggaccagcggaacauacggcacgggguccuggccugauggcgcugaccucaaccugaugcccauuuga

SEQ ID NO: 208055 - RNA, 1410 nt, Artificial Sequence
  derived and/or modified sequence opt5 from neuraminidase__InfluenzaA__AHL99632
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaaccauugagagaaauaucacagaaauuguguaucugaccaacacgaccaucgagaaggaaauuugcccuaaacccgcugaguaccggaauugguccaagccucagugugggaucacaggauucgcccccuuuucuaaagacaacagcauucgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcaucgccugguccucuagcuccugucaugauggcaaagccuggcuccacgugugcauuaccggcgacgauaagaacgcuaccgccagcuucaucuacaaugggcggcugguugacucuguggucuccuggagcaaagagauucuucgcacacaggaaucugagugugugugcaucaacggaacguguaccguggucaugacagauggcuccgcuagcgggaaggccgacaccaaaauucuguuuaucgaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 208056 - RNA, 1410 nt, Artificial Sequence; identical to SEQ ID NO: 207845
  derived and/or modified sequence opt5 from neuraminidase__InfluenzaA__AHL99644

SEQ ID NO: 208057 - RNA, 1410 nt, Artificial Sequence
  derived and/or modified sequence opt5 from neuraminidase__InfluenzaA__AHL99668
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgguggagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuaucgacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 208058 - RNA, 1410 nt, Artificial Sequence; identical to SEQ ID NO: 205170
  derived and/or modified sequence opt5 from neuraminidase__InfluenzaA__AHL99680

SEQ ID NO: 208059 - RNA, 1410 nt, Artificial Sequence
  derived and/or modified sequence opt5 from neuraminidase__InfluenzaA__AHL99692
augaaccccaaucagaagaucauuaccaucggcagcgugucccugacaauuucuacgaccugcuucuuuaugcaaaucgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacccgcugaguaccggaauugguccaagccucagugugggaucacaggauucgcccccuuuucuaaagacaacagcauucgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcaucgccugguccucuagcuccugucaugauggcaaagccuggcuccacgugugcauuaccggcgacgauaagaacgcuaccgccagcuucaucuacaaugggcggcugguugacucuguggucuccuggagcaaagagauucuucgcacacaggaaucugagugugugugcaucaacggaacguguaccguggucaugacagauggcuccgcuagcgggaaggccgacaccaaaauucuguuuaucgaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 208060 - RNA, 1410 nt, Artificial Sequence; identical to SEQ ID NO: 205170
  derived and/or modified sequence opt5 from neuraminidase__InfluenzaA__AHL99704

SEQ ID NO: 208061 - RNA, 1410 nt, Artificial Sequence; identical to SEQ ID NO: 205170
  derived and/or modified sequence opt5 from neuraminidase__InfluenzaA__AHL99716

SEQ ID NO: 208062 - RNA, 1410 nt, Artificial Sequence; identical to SEQ ID NO: 208052
  derived and/or modified sequence opt5 from neuraminidase__InfluenzaA__AHL99740

SEQ ID NO: 208063 - RNA, 1410 nt, Artificial Sequence
  derived and/or modified sequence opt5 from neuraminidase__InfluenzaA__AHL99751
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgguggagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgcccgggaccgcacgcccuauagaacacugcucaugaaugaacugggggugccuuuucaccugggaaccaagcaggucugcaucgccugguccucuagcuccugucaugauggcaaggcuuggcuccacgugugcauuacaggcgacgauaaaaacgccaccgcuagcuucaucuacaaugggcggcugguugacucuguggucuccuggagcaaagagauucuucgcacccaggaaucugagugugugugcaucaacggaacauguacgguggucaugaccgauggcuccgccagcgggaaggcggacacaaaaauucuguuuaucgaggaaggaaagaucguucauaccuccacacucucuggcagcgcccaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacaccccgcggaagaaugacagcuccucuagcucccauugccuuaacccuaauaacgaggaagggggacacggcgugaaagggugggcuuucgaugacggaaaugauguuuggaugggccgcacgauuaacgagacaagcagacugggguaugagaccuuuaaggugaucgaaggauggucuaaucccaaauccaagcuccagaucaaccggcaggucauuguggaccgcggcgauagaagcggcuacucugggaucuucuccgucgagggaaaaagcuguauuaaucggugcuuuuauguggaacugaucagaggccgcaaggaggaaaccgagguucuguggacauccaacucuauuguggucuucugugggaccagcggaacauacggcacgggguccuggccugacggcgccgaucucaaucugaugcccaucuga

SEQ ID NO: 208064 - RNA, 1410 nt, Artificial Sequence
  derived and/or modified sequence opt5 from neuraminidase__InfluenzaA__AHL99763
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagaugaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggacauccaauucuauuguggucuucugugggaccagcggaacauacggcacgggguccuggccugauggcgcugaccucaaccugaugcccaucuga

SEQ ID NO: 208065 - RNA, 1410 nt, Artificial Sequence; identical to SEQ ID NO: 205170
  derived and/or modified sequence opt5 from neuraminidase__InfluenzaA__AHL99775

SEQ ID NO: 208066 - RNA, 1410 nt, Artificial Sequence
  derived and/or modified sequence opt5 from neuraminidase__InfluenzaA__AHL99787
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccgaguccaaacuccagauuaaucggcaggucaucguggaucgcggcgacagaagcggcuacucugggauuuucuccgucgaaggaaagagcuguaucaaccggugcuuuuauguggagcugauuagaggccgcaaagaagagaccgagguucuguggacauccaauucuaucguggucuucugugggaccagcggaacauacggcacgggguccuggccugauggcgcugaccucaaccugaugcccauuuga

SEQ ID NO: 208067 - RNA, 1410 nt, Artificial Sequence
  derived and/or modified sequence opt5 from neuraminidase__InfluenzaA__AHL99799
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcgguguaucugccgcgauaacuggaagggaagcaauagacccauugucgacaucaacauuaaagaucacucuaucguguccagcuacguuuguucuggccuggugggcgacaccccgcggaagaaugacagcuccucuagcucccauugccuugggccuaacaaugaggaaggaggccacggggucaaaggaugggccuucgaugacggcaacgauguguggauggggcgcacgaucaaugagacaagcagacugggauaugagaccuuuaagguuauugaaggcuggucuaaccccaaauccaagcuccagaucaaucgccaggugauugucgaccggggcgauagaagcggguacucuggaaucuucuccguggagggcaaaagcuguauuaaccggugcuuuuaugucgaacugaucagagggcgcaaggaggaaaccgaggugcuguggacauccaauucuauuguuguguucuguggaaccagcggcacauacgggacgggcuccuggccugacggagcugaucucaaccugaugcccaucuga

SEQ ID NO: 208068 - RNA, 1410 nt, Artificial Sequence; identical to SEQ ID NO: 205170
  derived and/or modified sequence opt5 from neuraminidase__InfluenzaA__AHL99811

SEQ ID NO: 208069 - RNA, 1410 nt, Artificial Sequence
  derived and/or modified sequence opt5 from neuraminidase__InfluenzaA__AHL99823
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacaugugcuguggucaugacggauggcuccgccagcgggaaggcggacaccaaaauccuguuuaucgaggaaggaaagauuguucauacauccacccucucuggcagcgcccaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacacaccgcggaagaaugacagcuccucuagcucccauugccuugauccuaacaaugaggaagggggacacggcgugaaagggugggcuuucgacgauggaaacgacguuuggaugggccgcaccaucaaugagacgagcagacugggguaugagacauuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggaccuccaauucuaucguggucuucugugggacaagcggaaccuacggcacaggguccuggccugauggcgccgaccucaaccugaugcccauuuga

SEQ ID NO: 208070 - RNA, 1410 nt, Artificial Sequence
  derived and/or modified sequence opt5 from neuraminidase__InfluenzaA__AHL99835
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgcuccggacaaguguuaccaauucgcccugggacagggcaccacacuuaauaacgugcauagcaauaacaccguucgggaucgcacgcccuauagaacacugcucaugaaugaacugggggugccuuuucaccugggaaccaagcaggucugcauugccugguccucuagcuccugucaugacggcaaggcuuggcuccacgugugcaucacaggcgaugacaaaaacgccaccgcuagcuucauuuacaaugggcggcugguugauucuguggucuccuggagcaaagagauccuucgcacccaggaaucugagugugugugcauuaacggaacauguacgguggucaugaccgacggcuccgccagcgggaaggcggauacaaaaauccuguuuaucgaggaaggaaagauuguucauaccuccacacucucuggcagcgcccaacacguggaggaaugcuccugcuaucccagauacccuggggugcggugugucugccgcgacaacuggaagggaagcaauagacccaucguggauauuaacaucaaagaccacucuauuguuuccagcuacguguguucuggccuggucggcgauaccccgcggaagaaugacagcuccucuagcucccauugccuugacccuaacaaugaggaagggggacacggcgugaaagggugggcuuucgaugacggaaacgauguuuggaugggccgcacgaucaaugagacaagcagacugggguaugagaccuuuaaggugaucgaaggauggucuaaccccaaauccaagcuccugauuaaucggcaggucaucguggaccgcggcgauagaagcggcuacucugggauuuucuccgucgagggaaaaagcuguaucaaccggugcuuuuauguggaacugauuagaggccgcaaggaggaaaccgagguucucuggacauccaauucuaucguggucuucugugggaccagcggaacauacggcacgggguccuggccugacggcgccgaucugaaccuuaugcccauuuga

SEQ ID NO: 208071 - RNA, 1410 nt, Artificial Sequence; identical to SEQ ID NO: 205170
  derived and/or modified sequence opt5 from neuraminidase__InfluenzaA__AHL99847

SEQ ID NO: 208072 - RNA, 1410 nt, Artificial Sequence; identical to SEQ ID NO: 206399
  derived and/or modified sequence opt5 from neuraminidase__InfluenzaA__AHL99859

SEQ ID NO: 208073 - RNA, 1410 nt, Artificial Sequence
  derived and/or modified sequence opt5 from neuraminidase__InfluenzaA__AHL99871
augaaccccaaucagaagaucauuaccaucggcagcgugucccugacaauuucuacgaucugcuucuuuaugcaaauugccauccucaccacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacccgcugaguaccggaauugguccaagccucagugugacaucacaggguucgcccccuuuucuaaagauaacagcauucgccucuccgcgggaggcgacaucugggugaccagagagccuuaugucucuugcgauccggacaaguguuaccaauucgcucuggggcagggaacaacccuuaauaacgugcauagcaauaacacgguucgggaucgcacacccuauagaacccugcucaugaaugaacugggcgugccuuuucaccuggggacaaagcaggucugcaucgccugguccucuagcuccugucaugacggaaaagccuggcuccacgugugcauuaccggcgaugacaagaacgcuaccgccagcuucaucuacaauggccggcugguugauucuguggucuccuggagcaaagagauucuucgcacacaggaaucugagugugugugcaucaacgggacguguaccguggucaugacagacggauccgcuagcggcaaggccgauaccaaaauucuguuuaucgaggaagggagaaucguucauacauccacccucucuggaagcgcgcaacacguggaggaaugcuccugcuauccccgguacccuggcgugcgcugugucugcagagacaacuggaaggggagcaaucggcccauuguggauaucaacauuaaggaccacucuaucguuucccgcuacguguguagcggacuggucggcgacacgccgcggaaaaaugauucuagcuccucuagccauugccuugacccuaacaaugaggaaggcgggcacggagugaagggcugggccuucgaugacgggaacgauguuuggaugggaagaacaauuaaugagaccucccgccugggcuaugagaccuuuaaagugaucgaaggguggagcaaccccaagucuaaacuccagaucaauagacaggucauuguggaccggggagauagauccggcuacagcggcaucuucucugucgaggggaaguccuguauuaaccgcugcuuuuauguggaacugauccggggaagaaaagaggaaacagagguucuguggaccagcaauuccauuguggucuucuguggcacaucugggacguacggaaccggcagcuggccugacggggcugaucucaaccugaugcccaucuga

SEQ ID NO: 208074 - RNA, 1410 nt, Artificial Sequence; identical to SEQ ID NO: 205170
  derived and/or modified sequence opt5 from neuraminidase__InfluenzaA__AHL99883

SEQ ID NO: 208075 - RNA, 1410 nt, Artificial Sequence; identical to SEQ ID NO: 208051
  derived and/or modified sequence opt5 from neuraminidase__InfluenzaA__AHL99895

SEQ ID NO: 208076 - RNA, 1410 nt, Artificial Sequence; identical to SEQ ID NO: 205170
  derived and/or modified sequence opt5 from neuraminidase__InfluenzaA__AHL99907

SEQ ID NO: 208077 - RNA, 1410 nt, Artificial Sequence; identical to SEQ ID NO: 205170
  derived and/or modified sequence opt5 from neuraminidase__InfluenzaA__AHL99919

SEQ ID NO: 208078 - RNA, 1410 nt, Artificial Sequence
  derived and/or modified sequence opt5 from neuraminidase__InfluenzaA__AHL99943
augaaccccaaucagaagaucauuaccaucggcagcgugucccugacaauuucuacgaucugcuucuuuaugcaaauugccauccucaucaccacagucacccugcacuucaaacagcaugaguuuaacagcccuccgaauaaccagguuaugcuuugugaacccacaauuaucgagagaaauauuaccgaaaucguguaccugacaaacaccacgauugagaaggaaaucugcccuaaacccgcugaguaucggaauugguccaagccucagugugggauuaccggauucgcccccuuuucuaaagacaacagcauccgccucuccgcgggcggggauaucugggugacaagagagccuuacgucucuugcgacccggauaaguguuaucaauucgcucugggacagggcaccacacuuaauaacgugcacagcaauaacaccguucgggaccgcacgcccuacagaacacugcucaugaaugaacugggggugccuuuucaucugggaaccaagcaggucugcauugccugguccucuagcuccugucacgauggcaaagccuggcuccaugugugcaucacaggcgacgauaagaacgcuaccgccagcuucauuuauaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucacaccuccacacucucuggcagcgcgcaacacguggaggaaugcuccugcuaccccagauauccuggggugcggugugucugccgcgauaacuggaagggaagcaauagacccaucguggacauuaacaucaaagaucauucuauuguuuccagcuacguguguucuggccuggucggcgacaccccgcggaagaaugacagcuccucuagcucccacugccuugauccuaacaaugaggaagggggacauggcgugaaagggugggccuucgacgauggaaacgacguuuggaugggccgcacgaucaaugagacaagcagacugggguacgagaccuuuaaggugaucgaaggauggucuaaccccaaauccaagcuccagauuaaucggcaggucaucguggaucgcggcgacagaagcggcuauucugggauuuucuccgucgagggaaaaagcuguaucaaccggugcuuuuacguggaacugauuagaggccgcaaggaggaaaccgagguucuguggacauccaauucuaucguggucuucugugggaccagcggaacauauggcacgggguccuggccugauggcgcugaccucaaccugaugcccauuuga

SEQ ID NO: 208079 - RNA, 1410 nt, Artificial Sequence; identical to SEQ ID NO: 205170
  derived and/or modified sequence opt5 from neuraminidase__InfluenzaA__AHL99955

SEQ ID NO: 208080 - RNA, 1410 nt, Artificial Sequence
  derived and/or modified sequence opt5 from neuraminidase__InfluenzaA__AHL99967
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucacgaccggacgcccuaucgcacacugcucaugaaugaacugggggugccuuuucaucugggaaccaagcaggucugcauugccugguccucuagcuccugucacgauggcaaagccuggcuccaugugugcaucacaggcgacgauaagaacgcuaccgccagcuucauuuacaaugggagacugguugacucuguggucuccuggagcaaagagauccuucggacccaggaaucugagugugugugcauuaacggaacauguacgguggucaugaccgauggcuccgcuagcgggaaggccgacacaaaaauccuguuuaucgaggaaggaaagauuguucacaccuccacacucucuggcagcgcgcaacacguggaggaaugcuccugcuauccccgcuacccuggggugagaugugucugccgggauaacuggaagggaagcaaucgccccaucguggacauuaacaugaaagaucauucuaucguuuccagcuacguguguucuggccuggucggcgacaccccgagaaagaaugacagcuccucuagcucccacugccuugauccuaacaaugaggaagggggacauggcgugaaagggugggccuucgacgauggaaacgacguuuggaugggccggacgauuaaugagacaagccgccugggguaugagaccuuuaaggugaucgaaggauggucuaaccccaaauccaagcuccagaucaauagacaggucauuguggaucggggcgaccgcagcggcuacucugggaucuucuccgucgagggaaaaagcuguauuaacagaugcuuuuauguggaacugauccggggcagaaaggaggaaaccgagguucuguggacauccaauucuauuguggucuucugugggaccagcggaacauacggcacgggguccuggccugauggcgcugaccucaaccugaugcccaucuga

SEQ ID NO: 208081 - RNA, 1410 nt, Artificial Sequence
  derived and/or modified sequence opt5 from neuraminidase__InfluenzaA__AHL99979
augaaccccaaucagaagaucauuaccaucggcagcgugucccugacaauuucuacgaucugcuucuuuaugcaaauugccauccucaucaccacagucgcucugcacuucaaacagcaugaguuuaacagcccuccgaauaaccagguuaugcuuugugaacccaccauuaucgagagaaauauuacagaaaucguguaccugaccaacacaaccauugagaaggaaaucugcccuaaacccgccgaguaucggaauugguccaagccucagugugggauuacgggauucgcgcccuuuucuaaagacaacagcauccgccucuccgcuggcggggauaucugggugaccagagagccuuacgucucuugcgacccggauaaguguuaucaauucgcccugggacagggcacaacccuuaauaacgugcacagcaauaacacaguucgggaccgcacccccuacagaacgcugcucaugaaugaacugggggugccuuuucaucugggaacaaagcaggucugcauugccugguccucuagcuccugucacgauggcaaggcuuggcuccaugugugcaucaccggcgacgauaaaaacgccacagcuagcuucauuuauaaugggcggcugguugacucuguggucuccuggagcaaagagauccuucgcacccaggaaucugagugugugugcauuaacggaaccuguacaguggucaugacggauggcuccgccagcgggaaggcggacaccaaaauccuguuuaucgaggaaggaaagauuguucacacauccacccucucuggcagcgcccaacacguggaggaaugcuccugcuaccccagauauccuggggugcggugugucugccgcgauaacuggaagggaagcaauagacccaucguggacauuaacaucaaagaucauucuauuguuuccagcuacguguguucuggccuggucggcgacacaccgcggaagaaugacagcuccucuagcucccacugccuugauccuaacaaugaggaagggggacauggcgugaaagggugggcuuucgacgauggaaacgacguuuggaugggccgcaccaucaaugagacgagcagacugggguacgagacauuuaaggugaucgaaggauggucuaaccccaaauccaagcuccagauuaaucggcaggucaucguggaucgcggcgacagaagcggcuauucugggauuuucuccgucgagggaaaaagcuguaucaaccggugcuuuuacguggaacugauuagaggccgcaaggaggaaaccgagguucuguggaccuccaauucuaucguggucuucugugggacaagcggaaccuauggcacaggguccuggccugauggcgccgaccucaaccugaugcccauuuga

SEQ ID NO: 208082 - RNA, 1410 nt, Artificial Sequence; identical to SEQ ID NO: 208078
  derived and/or modified sequence opt5 from neuraminidase__InfluenzaA__AHL99991

SEQ ID NO: 208083 - RNA, 1410 nt, Artificial Sequence; identical to SEQ ID NO: 205170
  derived and/or modified sequence opt5 from neuraminidase__InfluenzaA__AHM00004

SEQ ID NO: 208084 - RNA, 1410 nt, Artificial Sequence; identical to SEQ ID NO: 205170
  derived and/or modified sequence opt5 from neuraminidase__InfluenzaA__AHM00016

SEQ ID NO: 208085 - RNA, 1410 nt, Artificial Sequence; identical to SEQ ID NO: 205170
  derived and/or modified sequence opt5 from neuraminidase__InfluenzaA__AHM00028

SEQ ID NO: 208086 - RNA, 1410 nt, Artificial Sequence; identical to SEQ ID NO: 208078
  derived and/or modified sequence opt5 from neuraminidase__InfluenzaA__AHM00040

SEQ ID NO: 208087 - RNA, 1410 nt, Artificial Sequence; identical to SEQ ID NO: 205170
  derived and/or modified sequence opt5 from neuraminidase__InfluenzaA__AHM00052

SEQ ID NO: 208088 - RNA, 1410 nt, Artificial Sequence; identical to SEQ ID NO: 206034
  derived and/or modified sequence opt5 from neuraminidase__InfluenzaA__AHM00064

SEQ ID NO: 208089 - RNA, 1410 nt, Artificial Sequence; identical to SEQ ID NO: 205170
  derived and/or modified sequence opt5 from neuraminidase__InfluenzaA__AHM00076

SEQ ID NO: 208090 - RNA, 1410 nt, Artificial Sequence; identical to SEQ ID NO: 205170
  derived and/or modified sequence opt5 from neuraminidase__InfluenzaA__AHM00088

SEQ ID NO: 208091 - RNA, 1410 nt, Artificial Sequence
  derived and/or modified sequence opt5 from neuraminidase__InfluenzaA__AHM00100
augaaccccaaucagaagaucauuaccaucggcagcauuugcaugacaaucgggauggccaaccugauucuccaaaucggaaauaucauuuccaucuggauuucucacagcauccagcugggcaaccagucccagauugagacguguaaucaaucugugaucaccuacgaaaacaauacaugggucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugaaguauaacggcgucaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccacaaaacaagacaucguuggcauuaaugaauggucuggguacagcggcuccuucgugcagcaucccgagcuuacgggacuggauuguauccgcccuugcuucugggucgaacucauuagaggccggcccaaggagaacaccaucuggacaagcgggucuuccauuagcuuuuguggaguuaauucugacaccgugggcugguccuggcccgauggggcugagcugccuuucacaaucgacaacuga

SEQ ID NO: 208092 - RNA, 1410 nt, Artificial Sequence; identical to SEQ ID NO: 208014
  derived and/or modified sequence opt5 from neuraminidase__InfluenzaA__AHM00111

SEQ ID NO: 208093 - RNA, 1410 nt, Artificial Sequence; identical to SEQ ID NO: 208078
  derived and/or modified sequence opt5 from neuraminidase__InfluenzaA__AHM00123

SEQ ID NO: 208094 - RNA, 1410 nt, Artificial Sequence; identical to SEQ ID NO: 206399
  derived and/or modified sequence opt5 from neuraminidase__InfluenzaA__AHM00135

SEQ ID NO: 208095 - RNA, 1410 nt, Artificial Sequence; identical to SEQ ID NO: 206907
  derived and/or modified sequence opt5 from neuraminidase__InfluenzaA__AHM00147

SEQ ID NO: 208096 - RNA, 1410 nt, Artificial Sequence; identical to SEQ ID NO: 208078
  derived and/or modified sequence opt5 from neuraminidase__InfluenzaA__AHM00159

SEQ ID NO: 208097 - RNA, 1410 nt, Artificial Sequence; identical to SEQ ID NO: 205170
  derived and/or modified sequence opt5 from neuraminidase__InfluenzaA__AHM00171

SEQ ID NO: 208098 - RNA, 1410 nt, Artificial Sequence; identical to SEQ ID NO: 205170
  derived and/or modified sequence opt5 from neuraminidase__InfluenzaA__AHM00183

SEQ ID NO: 208099 - RNA, 1410 nt, Artificial Sequence
  derived and/or modified sequence opt5 from neuraminidase__InfluenzaA__AHM00195
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaguucuguuuaucgaggaagggaagaucgugcauaccuccacacucucuggaagcgcgcaacacguggaggaaugcuccugcuaucccagauacccuggcguccggugugugugccgcgacaacuggaaggggagcaauagacccauuguugauaucaacauuaaagaccacucuaucgugucccgguacgucuguagcggacuggugggcgacaccccgcgcaagaaugauucuagcuccucuagccauugccuugacccuaacaaugaggaaggcgggcacggaguuaaaggcugggccuucgaugacgggaacgauguguggaugggaagaacgauuaaugagacaucccggcugggcuaugagaccuuuaaggucaucgaaggguggagcaaccccaaaucuaagcuccagaucaaucgccaggugauugucgacagaggagaucgguccggcuacagcggcaucuucucuguggaggggaaauccuguauuaacagaugcuuuuauguugaacugauccgcggacggaaggaggaaaccgaggugcuguggacaagcaauuccauugucguguucuguggcaccucugggacauacggaacgggcagcuggccugacggggcugaucucaaccugaugcccaucuga

SEQ ID NO: 208100 - RNA, 1410 nt, Artificial Sequence
  derived and/or modified sequence opt5 from neuraminidase__InfluenzaA__AHM00207
augaaccccaaucagaagaucauuaccaucggcagcgugucccugacaauuucuacgaucugcuucuuuaugcaaauugccauccucaucaccacagucacccugcacuucaaacagcaugaguuuaacagcccuccgaauaaccagguuaugcuuugugaacccacaauuaucgagagaaauauuaccgaaaucguguaccugacaaacaccacgauugagaaggaaaucugcccuaaacccgcugaguaucggaauugguccaagccucagugugggauuaccggauucgcccccuuuucuaaagacaacagcauccgccucuccgcgggcgggaauaucugggugacaagagagccuuacgucucuugcgauccggacaaguguuaucaauucgcucugggacagggcaccacacuuaacaaugugcacagcaacaauaccguucgggaucgcacgcccuacagaacacugcucaugaacgaacugggggugccuuuucaucugggaaccaagcaggucugcauugccugguccucuagcuccugucacgacggcaaagccuggcuccaugugugcaucacaggcgaugacaagaaugcuaccgccagcuucauuuauaacgggcggcugguugauucuguggucuccuggagcaaagagauccuucgcacccaggaaucugagugugugugcauuaacggaacauguacgguggucaugaccgacggcuccgcuagcgggaaggccgauacaaaaauccuguuuaucgaggaaggaaagauuguucacaccuccacacucucuggcagcgcgcaacacguggaggaaugcuccugcuaccccagauauccuggggugcggugugucugccgcgacaauuggaagggaagcaacagacccaucguggauauuaauaucaaagaccauucuauuguuuccagcuacguguguucuggccuggucggcgauaccccgcggaagaacgacagcuccucuagcucccacugccuugacccuaauaacgaggaagggggacauggcgugaaagggugggccuucgaugacggaaaugauguuuggaugggccgcacgaucaacgagacaagcagacugggguacgagaccuuuaaggugaucgaaggauggucuaaucccaaauccaagcuccagauuaaccggcaggucaucguggaccgcggcgauagaagcggcuauucugggauuuucuccgucgagggaaaaagcuguaucaaucggugcuuuuacguggaacugauuagaggccgcaaggaggaaaccgagguucuguggacauccaacucuaucguggucuucugugggaccagcggaacauauggcacgggguccuggccugacggcgcugaucucaaucugaugcccauuuga

SEQ ID NO: 208101 - RNA, 1410 nt, Artificial Sequence; identical to SEQ ID NO: 208078
  derived and/or modified sequence opt5 from neuraminidase__InfluenzaA__AHM00219

SEQ ID NO: 208102 - RNA, 1410 nt, Artificial Sequence; identical to SEQ ID NO: 205170
  derived and/or modified sequence opt5 from neuraminidase__InfluenzaA__AHM00231

SEQ ID NO: 208103 - RNA, 1410 nt, Artificial Sequence; identical to SEQ ID NO: 205170
  derived and/or modified sequence opt5 from neuraminidase__InfluenzaA__AHM00243

SEQ ID NO: 208104 - RNA, 1410 nt, Artificial Sequence; identical to SEQ ID NO: 205170
  derived and/or modified sequence opt5 from neuraminidase__InfluenzaA__AHM00255

SEQ ID NO: 208105 - RNA, 1410 nt, Artificial Sequence
  derived and/or modified sequence opt5 from neuraminidase__InfluenzaA__AHM00267
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggcuuccuggagcaaagagauccuucgcacccaggaaucugagugugucugcauuaacggaacauguacgguggugaugaccgauggcuccgccagcgggaaggcggacacaaaaauccuguuuaucgaggaaggaaagauuguccauaccuccacacucucuggcagcgcccaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggcuuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuaucguuguguucugugggaccagcggaacauacggcacgggguccuggccugauggcgccgaccucaaccugaugcccauuuga

SEQ ID NO: 208106 - RNA, 1410 nt, Artificial Sequence; identical to SEQ ID NO: 206399
  derived and/or modified sequence opt5 from neuraminidase__InfluenzaA__AHM00279

SEQ ID NO: 208107 - RNA, 1410 nt, Artificial Sequence; identical to SEQ ID NO: 205170
  derived and/or modified sequence opt5 from neuraminidase__InfluenzaA__AHM00291

SEQ ID NO: 208108 - RNA, 1410 nt, Artificial Sequence; identical to SEQ ID NO: 205170
  derived and/or modified sequence opt5 from neuraminidase__InfluenzaA__AHM00303

SEQ ID NO: 208109 - RNA, 1410 nt, Artificial Sequence; identical to SEQ ID NO: 205170
  derived and/or modified sequence opt5 from neuraminidase__InfluenzaA__AHM00315

SEQ ID NO: 208110 - RNA, 1410 nt, Artificial Sequence; identical to SEQ ID NO: 206399
  derived and/or modified sequence opt5 from neuraminidase__InfluenzaA__AHM00327

SEQ ID NO: 208111 - RNA, 1410 nt, Artificial Sequence; identical to SEQ ID NO: 206399
  derived and/or modified sequence opt5 from neuraminidase__InfluenzaA__AHM00339

SEQ ID NO: 208112 - RNA, 1410 nt, Artificial Sequence; identical to SEQ ID NO: 208078
  derived and/or modified sequence opt5 from neuraminidase__InfluenzaA__AHM00351

SEQ ID NO: 208113 - RNA, 1410 nt, Artificial Sequence; identical to SEQ ID NO: 208014
  derived and/or modified sequence opt5 from neuraminidase__InfluenzaA__AHM00363

SEQ ID NO: 208114 - RNA, 1410 nt, Artificial Sequence
  derived and/or modified sequence opt5 from neuraminidase__InfluenzaA__AHM00375
augaaccccaaucagaagaucauuaccaucggcagcgugucccugacaauuucuacgaucugcuucuuuaugcaaauugccauccucaucaccacagucacccugcacuucaaacagcaugaguuuaacagcccuccgaauaaccagguuaugcuuugugaacccacaauuaucgagagaaauauuaccgaaaucguguaccugacaaacaccacgauugagaaggaagugugcccuaaacccgcugaguaucggaauugguccaagccucagugugggaucaccggauucgcccccuuuucuaaagacaacagcauucgccucuccgcgggcggggauaucugggucacaagagagccuuacgugucuugcgacccggauaaguguuaucaauucgcucugggacagggcaccacacuuaauaacguucacagcaauaacaccgugcgggaccgcacgcccuacagaacacugcucaugaaugaacugggggucccuuuucaucugggaaccaaacaggugugcaucgccugguccucuagcuccugucacgauggcaaggccuggcuccauguuugcauuacaggcgacgauaagaacgcuaccgccagcuucaucuauaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcacaccuccacacucucuggcagcgcgcaacacguggaggaaugcuccugcuaccccagauauccugggguccggugugugugccgcgauaacuggaagggaagcaauagacccauuguugacaucaacauuaaagaucauucuaucguguccagcuacgucuguucuggccuggugggcgacaccccgcggaagaaugacagcuccucuagcucccacugccuugauccuaacaaugaggaagggggacauggcguuaaagggugggccuucgacgauggaaacgacguguggaugggccgcacgauuaaugagacaagcagacugggguacgagaccuuuaaggucaucgaaggauggucuaaccccaaauccaagcuccagaucaaucgccaggugauugucgaucggggcgacagaagcggcuauucugggaucuucuccguggagggaaaaagcuguauuaaccggugcuuuuacguugaacugaucagaggccgcaaggaggaaaccgaggugcuguggacauccaauucuauugucguguucugugggaccagcggaacauauggcacgggguccuggccugauggcgcugaccucaaccugaugcccaucuga

SEQ ID NO: 208115 - RNA, 1410 nt, Artificial Sequence
  derived and/or modified sequence opt5 from neuraminidase__InfluenzaA__AHM00398
augaaccccaaucagaagaucauuaccaucggcagcgugucccugacaauuucuacgaucugcuucuuuaugcaaauugccauccucaucaccacagucacccugcacuucaaacagcaugaguuuaacagcccuccgaauaaccagguuaugcuuugugaacccacaauuaucgagagaaauauuaccgaaaucguguaccugacaaacaccacgauugagaaggaaaucugcccuaaacccgcugaguaucggaauugguccaagccucagugugggauuaccggauucgcccccuuuucuaaagagaacagcauccgccucuccgcgggcggggacaucugggugacaagagaaccuuacgucucuugcgauccggacaaguguuaucaauucgcucugggacagggcaccacacuuaauaacgugcacagcaauaacaccguucgggaucgcacgcccuacagaacacugcucaugaaugagcugggggugccuuuucaucugggaaccaagcaggucugcauugccugguccucuagcuccugucacgacggcaaagccuggcuccaugugugcaucacaggcgaugacaagaacgcuaccgccagcuucauuuauaaugggcggcugguugauucuguggucuccuggagcaaagaaauccuucgcacccaggagucugagugugugugcauuaacggaacauguacgguggucaugaccgacggcuccgcuagcgggaaggccgauacaaaaauccuguuuaucgaagagggaaagauuguucacaccuccacacucucuggcagcgcgcaacacguggaagagugcuccugcuaccccagauauccuggggugcggugugucugccgcgacaacuggaagggaagcaauagacccaucguggauauuaacaucaaagaccauucuauuguuuccagcuacguguguucuggccuggucggcgauaccccgcggaagaaugacagcuccucuagcucccacugccuugacccuaacaaugaagaagggggacauggcgugaaagggugggccuucgaugacggaaacgauguuuggaugggccgcacgaucaaugagacaagcagacugggguacgagaccuuuaaggugaucgagggauggucuaaccccaaauccaagcuccagauuaaucggcaggucaucguggaccgcggcgauagaagcggcuauucugggauuuucuccgucgaaggaaaaagcuguaucaaccggugcuuuuacguggagcugauuagaggccgcaaggaagagaccgagguucuguggacauccucuagcaucguggucuucugugggaccuccggaacauauggcacggggucuuggccugacggcgcugaucucaaucugaugcccauuuga

SEQ ID NO: 208116 - RNA, 1410 nt, Artificial Sequence; identical to SEQ ID NO: 205170
  derived and/or modified sequence opt5 from neuraminidase__InfluenzaA__AHM00410

SEQ ID NO: 208117 - RNA, 1410 nt, Artificial Sequence
  derived and/or modified sequence opt5 from neuraminidase__InfluenzaA__AHM00422
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 208118 - RNA, 1410 nt, Artificial Sequence
  derived and/or modified sequence opt5 from neuraminidase__InfluenzaA__AHM00434
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaaccugcugaguaccggaauuggagcaagccccagugugggauuaccggauucgccccuuuuuccaaagacaacucuauccgccucagcgcgggcggggauaucugggugacaagagagccguaugucuccugcgaccccgauaaguguuaccaauucgcucugggacagggcaccacacuuaauaacgugcauucuaauaacaccguucgggaccgcacgccuuauagaacacugcucaugaaugaacugggggugcccuuucaccugggaaccaagcaggucugcauugccuggagcuccagcucuugucaugauggcaaagccuggcuccacgugugcaucacaggcgacgauaagaacgcuaccgccuccuucauuuacaaugggcggcugguugacagcguggucucuugguccaaagagauccuucgcacccaggaaagcgagugugugugcauuaacggaacauguacgguggucaugaccgauggcucugcuuccgggaaggccgacacaaaaauccuguuuaucgaggaaggaaagauuguucauaccagcacacucuccggcucugcgcaacacguggaggaaugcagcugcuauccuagauaccccggggugcggugugucugccgcgauaacuggaagggauccaauagaccgaucguggacauuaacaucaaagaucacagcauuguuucuuccuacguguguagcggccuggucggcgacaccccucggaagaaugacucuagcuccucuagccauugccuugaucccaacaaugaggaagggggacacggcgugaaagggugggccuucgacgauggaaacgacguuuggaugggccgcacgaucaaugagacauccagacugggguaugagaccuuuaaggugaucgaaggauggagcaacccuaaaucuaagcuccagauuaaucggcaggucaucguggaucgcggcgacagauccggcuacagcgggauuuucucugucgagggaaaauccuguaucaaccggugcuuuuauguggaacugauuagaggccgcaaggaggaaaccgagguucuguggacaagcaauuccaucguggucuucugugggaccucuggaacauacggcacggggagcuggcccgauggcgcugaccucaaccugaugcccauuuga

SEQ ID NO: 208119 - RNA, 1410 nt, Artificial Sequence; identical to SEQ ID NO: 205170
  derived and/or modified sequence opt5 from neuraminidase__InfluenzaA__AHM00446

SEQ ID NO: 208120 - RNA, 1410 nt, Artificial Sequence; identical to SEQ ID NO: 208078
  derived and/or modified sequence opt5 from neuraminidase__InfluenzaA__AHM00458

SEQ ID NO: 208121 - RNA, 1410 nt, Artificial Sequence; identical to SEQ ID NO: 208078
  derived and/or modified sequence opt5 from neuraminidase__InfluenzaA__AHM00470

SEQ ID NO: 208122 - RNA, 1410 nt, Artificial Sequence; identical to SEQ ID NO: 208078
  derived and/or modified sequence opt5 from neuraminidase__InfluenzaA__AHM00482

SEQ ID NO: 208123 - RNA, 1410 nt, Artificial Sequence; identical to SEQ ID NO: 208078
  derived and/or modified sequence opt5 from neuraminidase__InfluenzaA__AHM00494

SEQ ID NO: 208124 - RNA, 1410 nt, Artificial Sequence
  derived and/or modified sequence opt5 from neuraminidase__InfluenzaA__AHM00506
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucgugaaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 208125 - RNA, 1410 nt, Artificial Sequence; identical to SEQ ID NO: 205170
  derived and/or modified sequence opt5 from neuraminidase__InfluenzaA__AHM00518

SEQ ID NO: 208126 - RNA, 1410 nt, Artificial Sequence
  derived and/or modified sequence opt5 from neuraminidase__InfluenzaA__AHM00530
augaaccccaaucagaagaucauuaccaucggcagcgugucccugacaauuucuacgaucugcuucagcaugcaaauugccauccucaucaccacagucacccugcacuuuaaacaguacgaguucaacccuccgcccaauaaccagguuaugcuuugugaaccuacaauuaucgagagaaauauuaccgaaaucguguaucugacaaacaccacgauugagaaggaaaucugccccaaaccugcugaguaccggaauugguccaagccccagugugggauuaccggauuugccccuuucucuaaagacaacagcauccgccucuccgcgggcggggauaucugggugacaagagagccguaugucucuugcgaccccgauaaguguuaccaauuugcucugggacagggcaccacacuuaauaacgugcauagcaauaacaccguucgggaccgcacgccuuauagaacacugcucaugaaugaacugggggugcccuuccaccugggaaccaagcaggucugcauugccugguccuccucuuccugucaugauggcaaagccuggcuccacgugugcaucacaggcgacgauaagaacgcuaccgccagcuuuauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguucaucgaggaaggaaagauuguucauaccuccacacucucuggcagcgcgcaacacguggaggaaugcuccugcuauccuagauaccccggggugcggugugucugccgcgauaacuggaagggaagcaauagaccgaucguggacauuaacaucaaagaucacucuauuguuuccagcuacguguguucuggccuggucggcgacaccccucggaagaaugacagcuccucuagcucccauugccuugaucccaacaaugaggaagggggacacggcgugaaagggugggccuuugacgauggaaacgacguuuggaugggccgcacgaucaaugagacaagcagacugggguaugagaccuucaaggugaucgaaggauggucuaacccuaaauccaagcuccagauuaaucggcaggucaucguggaucgcggcgacagaagcggcuacucugggauuuuuagcgucgagggaaaaagcuguaucaaccggugcuucuauguggaacugauuagaggccgcaaggaggaaaccgagguucuguggacauccaauucuaucguggucuuuugugggaccagcggaacauacggcacgggguccuggcccgauggcgcugaccucaaccugaugcccauuuga

SEQ ID NO: 208127 - RNA, 1410 nt, Artificial Sequence; identical to SEQ ID NO: 206399
  derived and/or modified sequence opt5 from neuraminidase__InfluenzaA__AHM00542

SEQ ID NO: 208128 - RNA, 1410 nt, Artificial Sequence
  derived and/or modified sequence opt5 from neuraminidase__InfluenzaA__AHM00546
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccaaguacguguguagcggacuggucggcgacaccccgcggaaaaaugauucuagcuccucuagccauugccuugacccuaacaaugaggaaggcgggcacggagugaagggcugggccuucgaugacgggaacgauguuuggaugggacgcacgaucaaugagacauccagacugggcuaugagaccuuuaaagugaucgaaggguggagcaaccccaagucuaaacuccagauuaaucggcaggucaucguggaccgcggagauagauccggcuacagcggcauuuucucugucgaggggaaguccuguaucaaccggugcuuuuauguggaacugauuagaggacgcaaggaggaaaccgagguucuguggacaagcaauuccaucguggucuucuguggcaccucugggacauacggaacgggcagcuggccugacggggcugaucucaaccugaugcccauuuga

SEQ ID NO: 208129 - RNA, 1410 nt, Artificial Sequence
  derived and/or modified sequence opt5 from neuraminidase__InfluenzaA__AHM00558
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaagugugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 208130 - RNA, 1410 nt, Artificial Sequence; identical to SEQ ID NO: 205170
  derived and/or modified sequence opt5 from neuraminidase__InfluenzaA__AHM00570

SEQ ID NO: 208131 - RNA, 1410 nt, Artificial Sequence; identical to SEQ ID NO: 205170
  derived and/or modified sequence opt5 from neuraminidase__InfluenzaA__AHM00582

SEQ ID NO: 208132 - RNA, 1410 nt, Artificial Sequence
  derived and/or modified sequence opt5 from neuraminidase__InfluenzaA__AHM00594
augaaccccaaucagaagaucauuaccaucggcagcgugucccugacaauuucuacgaucugcuucuuuaugcaaauugccauccucaucaccacagucacccugcacuucaaacagcaugaguuuaacagcccuccgaauaaccagguuaugcuuugugaacccacaauuaucgagagaaauauuaccgaaaucgugcaccugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucacaccuccacacucucuggcagcgcgcaacauguggaggaaugcuccugcuaucccagauacccuggggugcggugugucugccgcgauaacuggaagggaagcaauagacccaucguggacauuaacaucaaagaucacucuauuguuuccagcuauguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguacgagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 208133 - RNA, 1410 nt, Artificial Sequence; identical to SEQ ID NO: 205170
  derived and/or modified sequence opt5 from neuraminidase__InfluenzaA__AHM00606

SEQ ID NO: 208134 - RNA, 1410 nt, Artificial Sequence; identical to SEQ ID NO: 205170
  derived and/or modified sequence opt5 from neuraminidase__InfluenzaA__AHM00618

SEQ ID NO: 208135 - RNA, 1410 nt, Artificial Sequence; identical to SEQ ID NO: 205170
  derived and/or modified sequence opt5 from neuraminidase__InfluenzaA__AHM00630

SEQ ID NO: 208136 - RNA, 1410 nt, Artificial Sequence; identical to SEQ ID NO: 205170
  derived and/or modified sequence opt5 from neuraminidase__InfluenzaA__AHM00642

SEQ ID NO: 208137 - RNA, 1410 nt, Artificial Sequence; identical to SEQ ID NO: 206399
  derived and/or modified sequence opt5 from neuraminidase__InfluenzaA__AHM00654

SEQ ID NO: 208138 - RNA, 1410 nt, Artificial Sequence; identical to SEQ ID NO: 205170
  derived and/or modified sequence opt5 from neuraminidase__InfluenzaA__AHM00666

SEQ ID NO: 208139 - RNA, 1410 nt, Artificial Sequence; identical to SEQ ID NO: 208078
  derived and/or modified sequence opt5 from neuraminidase__InfluenzaA__AHM00678

SEQ ID NO: 208140 - RNA, 1410 nt, Artificial Sequence; identical to SEQ ID NO: 206413
  derived and/or modified sequence opt5 from neuraminidase__InfluenzaA__AHM00690

SEQ ID NO: 208141 - RNA, 1410 nt, Artificial Sequence; identical to SEQ ID NO: 206399
  derived and/or modified sequence opt5 from neuraminidase__InfluenzaA__AHM00701

SEQ ID NO: 208142 - RNA, 1410 nt, Artificial Sequence
  derived and/or modified sequence opt5 from neuraminidase__InfluenzaA__AHM00713
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaauccgcugaguaccggaauuggucuaagccccagugugggauuaccggauucgccccuuuuagcaaagacaacuccauccgccucucugcgggcggggauaucugggugacaagagagcccuaugucagcugcgacccugauaaguguuaccaauucgcucugggacagggcaccacacuuaauaacgugcauuccaauaacaccguucgggaccgcacgccguauagaacacugcucaugaaugaacugggggugcccuuucaccugggaaccaagcaggucugcauugccuggucuagcuccagcugucaugauggcaaagccuggcuccacgugugcaucacaggcgacgauaagaacgcuaccgccucuuucauuuacaaugggcggcugguugacuccguggucagcuggucuaaagagauccuucgcacccaggaauccgagugugugugcauuaacggaacauguacgguggucaugaccgauggcagcgcuuccgggaaggccgacacaaaaauccuguuuaucgaggaaggaaagauuguucauaccucuacacucagcggcuccgcgcaacacguggaggaaugcagcugcuauccuagauaccccggggugcggugugucugccgcgauaacuggaagggaucuaauagaccuaucguggacauuaacaucaaagaucacuccauuguuagcucuuacguguguagcggccuggucggcgacacgccccggaagaaugacuccucuagcuccagccauugccuugauccgaacaaugaggaagggggacacggcgugaaagggugggccuucgacgauggaaacgacguuuggaugggccgcaccaucaaugagacaucuagacugggguaugagaccuuuaaggugaucgaaggaugguccaacccuaaaagcaagcuccagauuaaucggcaggucaucguggaucgcggcgacagaucuggcuacuccgggauuuucagcgucgagggaaaauccuguaucaaccggugcuuuuauguggaacugauuagaggccgcaaggaggaaaccgagguucuguggacaucuaauagcaucguggucuucugugggaccuccggaacauacggcacggggucuuggcccgauggcgcugaccucaaccugaugccuauuuga

SEQ ID NO: 208143 - RNA, 1410 nt, Artificial Sequence; identical to SEQ ID NO: 205170
  derived and/or modified sequence opt5 from neuraminidase__InfluenzaA__AHM00725

SEQ ID NO: 208144 - RNA, 1410 nt, Artificial Sequence; identical to SEQ ID NO: 205170
  derived and/or modified sequence opt5 from neuraminidase__InfluenzaA__AHM00737

SEQ ID NO: 208145 - RNA, 1410 nt, Artificial Sequence; identical to SEQ ID NO: 208078
  derived and/or modified sequence opt5 from neuraminidase__InfluenzaA__AHM00749

SEQ ID NO: 208146 - RNA, 1410 nt, Artificial Sequence; identical to SEQ ID NO: 205170
  derived and/or modified sequence opt5 from neuraminidase__InfluenzaA__AHM00761

SEQ ID NO: 208147 - RNA, 1410 nt, Artificial Sequence; identical to SEQ ID NO: 206399
  derived and/or modified sequence opt5 from neuraminidase__InfluenzaA__AHM00785

SEQ ID NO: 208148 - RNA, 1410 nt, Artificial Sequence; identical to SEQ ID NO: 206034
  derived and/or modified sequence opt5 from neuraminidase__InfluenzaA__AHM00797

SEQ ID NO: 208149 - RNA, 1410 nt, Artificial Sequence
  derived and/or modified sequence opt5 from neuraminidase__InfluenzaA__AHM00809
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacccgcugaguaccggaauugguccaagccucagugugacaucaccggguucgcccccuuuucuaaagauaacagcauccgccucuccgcgggaggcgacauuugggugacaagagagccuuaugucucuugcgauccggacaaguguuaccaauucgcucuggggcagggaaccacacuuaauaacaugcauagcaauaacaccgugcgggaucgcacgcccuauagaacacugcucaugaaugaacugggcguuccuuuucaccuggggaccaaacaggugugcaucgccugguccucuagcuccugucaugacggaaaggccuggcuccacgucugcauuacaggcgaugacaagaacgcuaccgccagcuucaucuacaauggccggcugguggauucuguuguguccuggagcaaagagauucuucgcacccaggaaucugagugugucugcaucaacgggacauguacgguggugaugaccgacggauccgcuagcggcaaggccgauacaaaaauccuguuuauugaggaagggaagaucguccauaccuccacacucucuggaagcgcgcaacacguugaggaaugcuccugcuaucccagauacccuggcgugcggugugugugccgcgacaacuggaaggggagcaauagacccauugucgauaucaacauuaaagaccacucuaucguguccagcuacguuuguucuggacuggugggcgacaccccgcggaagaaugauagcuccucuagcucccauugccuugacccuaacaaugaggaaggcgggcacggagucaaaggcugggccuucgaugacgggaacgauguguggaugggacgcacgaucaaugagacaagcagacugggcuaugagaccuuuaagguuauugaaggguggucuaaccccaaauccaagcuccagaucaaucgccaggugauugucgaccggggagauagaagcggcuacucuggcaucuucuccguggaggggaaaagcuguauuaaccggugcuuuuaugucgaacugaucagaggacgcaaggaggaaaccgaggugcuguggacauccaauucuauuguuguguucuguggcaccagcgggacauacggaacgggcuccuggccugacggggcugaucucaaccugaugcccaucuga

SEQ ID NO: 208150 - RNA, 1410 nt, Artificial Sequence; identical to SEQ ID NO: 208078
  derived and/or modified sequence opt5 from neuraminidase__InfluenzaA__AHM00821

SEQ ID NO: 208151 - RNA, 1410 nt, Artificial Sequence; identical to SEQ ID NO: 208078
  derived and/or modified sequence opt5 from neuraminidase__InfluenzaA__AHM00833

SEQ ID NO: 208152 - RNA, 1410 nt, Artificial Sequence; identical to SEQ ID NO: 206034
  derived and/or modified sequence opt5 from neuraminidase__InfluenzaA__AHM00845

SEQ ID NO: 208153 - RNA, 1410 nt, Artificial Sequence; identical to SEQ ID NO: 205170
  derived and/or modified sequence opt5 from neuraminidase__InfluenzaA__AHM00857

SEQ ID NO: 208154 - RNA, 1410 nt, Artificial Sequence; identical to SEQ ID NO: 205170
  derived and/or modified sequence opt5 from neuraminidase__InfluenzaA__AHM00869

SEQ ID NO: 208155 - RNA, 1410 nt, Artificial Sequence; identical to SEQ ID NO: 205170
  derived and/or modified sequence opt5 from neuraminidase__InfluenzaA__AHM00881

SEQ ID NO: 208156 - RNA, 1410 nt, Artificial Sequence; identical to SEQ ID NO: 206399
  derived and/or modified sequence opt5 from neuraminidase__InfluenzaA__AHM00893

SEQ ID NO: 208157 - RNA, 1410 nt, Artificial Sequence
  derived and/or modified sequence opt5 from neuraminidase__InfluenzaA__AHM00905
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagacggacagcuccucuagcgggcauugccuugauccuaauaacgaggaaggaggccacggggugaaaggaugggccuucgacgauggcaaugacguuuggauggggcgcacaaucaacgagaccuccagacugggauaugagaccuuuaaggugaucgaaggcuggagcaaucccaaaucuaagcuccagauuaaccggcaggucaucguggaucgcggcgacagauccggguacagcggaauuuucucugucgagggcaaauccuguaucaaucggugcuuuuauguggaacugauuagagggcgcaaggaggaaacagagguucuguggaccagcaacuccaucguggucuucuguggaacaucuggcacguacgggaccggcagcuggccugauggagcugaccucaaucugaugcccauuuga

SEQ ID NO: 208158 - RNA, 1410 nt, Artificial Sequence
  derived and/or modified sequence opt5 from neuraminidase__InfluenzaA__AHM00917
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacaucuggaugggccgcacgaucaaugagacaagcagacugggguaugagaccuuuaagguuauugaaggauggucuaaccccaaauccaagcuccagaucaaucgccaggugauugucgaucggggcgacagaagcggcuacucugggaucuucuccguggagggaaaaagcuguauuaaccggugcuuuuaugucgaacugaucagaggccgcaaggaggaaaccgaggugcuguggacauccaauucuauuguuguguucugugggaccagcggaacauacggcacgggguccuggccugauggcgcugaccucaaccugaugcccaucuga

SEQ ID NO: 208159 - RNA, 1410 nt, Artificial Sequence; identical to SEQ ID NO: 205170
  derived and/or modified sequence opt5 from neuraminidase__InfluenzaA__AHM00929

SEQ ID NO: 208160 - RNA, 1410 nt, Artificial Sequence
  derived and/or modified sequence opt5 from neuraminidase__InfluenzaA__AHM00941
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccauucgggaucgcacgcccuauagaacacugcucaugaaugaacugggcguuccuuuucaccuggggaccaaacaggugugcaucgccugguccucuagcuccugucaugacggaaaggccuggcuccacgucugcauuacaggcgaugacaagaacgcuaccgccagcuucaucuacaauggccggcugguggauucuguuguguccuggagcaaagagauucuucgcacccaggaaucugagugugucugcaucaacgggacauguacgguggugaugaccgacggauccgcuagcggcaaggccgauacaaaaauccuguuuauugaggaagggaagaucguccauaccuccacacucucuggaagcgcgcaacacguugaggaaugcuccugcuaucccagauacccuggcgugcggugugugugccgcgacaacuggaaggggagcaauagacccauugucgauaucaacauuaaagaccacucuaucgugucccgguacguuuguagcggacuggugggcgacaccccgcgcaagaaugauucuagcuccucuagccauugccuugacccuaacaaugaggaaggcgggcacggagucaaaggcugggccuucgaugacgggaacgauguguggaugggaagaacgaucaaugagacaucccggcugggcuaugagaccuuuaagguuauugaaggguggagcaaccccaaaucuaagcuccagaucaaucgccaggugauugucgacagaggagaucgguccggcuacagcggcaucuucucuguggaggggaaauccuguauuaacagaugcuuuuaugucgaacugauccgcggacggaaggaggaaaccgaggugcuguggacaagcaauuccauuguuguguucuguggcaccucugggacauacggaacgggcagcuggccugacggggcugaucucaaccugaugcccaucuga

SEQ ID NO: 208161 - RNA, 1410 nt, Artificial Sequence
  derived and/or modified sequence opt5 from neuraminidase__InfluenzaA__AHM00953
augaaccccaaucagaagaucauuaccaucggcagcgugucccugacaauuucuacgaucugcuucuuuaugcaaauugccauccucaucaccacagucacccugcacuucaaacaguacgcuuuuaacagcccuccgaauaaccagguuaugcuuugugagcccacaauuaucgaaagaaauauuaccgagaucguguaucugacaaacaccacgauugaaaaggagaucugcccuaaacccgccgaauaccggaauugguccaagccucagugugggauuaccggauucgcgcccuuuucuaaagacaacagcauccgccucuccgcuggcggggauaucugggugacaagagagccuuaugucucuugcgacccggauaaguguuaccaauucgcccugggacagggcaccacacuuaauaacgugcauagcaauaacaccguucgggaccgcacgcccuauagaacacugcucaugaaugagcugggggugccuuuucaccugggaaccaagcaggucugcauugccugguccucuagcuccugucaugauggcaaggcuuggcuccacgugugcaucacaggcgacgauaaaaacgccaccgcuagcuucauuuacaaugggcggcugguugacucuguggucuccuggagcaaagaaauccuucgcacccaggagucugaaugugugugcauuaacggaacauguacgguggucaugaccgauggcuccgccagcgggaaggcggacacaaaaauccuguuuaucgaggagggaaagauuguucauaccuccacacucucuggcagcgcccaacacguggaagagugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaagaagggggacacggcgugaaagggugggcuuucgacgauggaaacgacguuuggaugggccgcacgaucaaugagacaagcagacugggguaugagaccuuuaaggugaucgagggauggucuaaccccaaauccaagcuccagauuaaucggcaggucaucguggaucgcggcgacagaagcggcuacucugggauuuucuccgucgaaggaaaaagcuguaucaaccggugcuuuuauguggagcugauuagaggccgcaaggaagagaccgaaguucuguggacauccaauucuaucguggucuucugugggaccagcggaacauacggcacgggguccuggccugauggcgccgaccucaaccugaugcccauuuga

SEQ ID NO: 208162 - RNA, 1410 nt, Artificial Sequence; identical to SEQ ID NO: 206399
  derived and/or modified sequence opt5 from neuraminidase__InfluenzaA__AHM00965

SEQ ID NO: 208163 - RNA, 1410 nt, Artificial Sequence; identical to SEQ ID NO: 206399
  derived and/or modified sequence opt5 from neuraminidase__InfluenzaA__AHM00977

SEQ ID NO: 208164 - RNA, 1398 nt, Artificial Sequence
  derived and/or modified sequence opt5 from neuraminidase__InfluenzaA__AHM24226
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacggcacaauccacgacagaagccaauaucgggcucugauuucuuggccccuguccagcccucccaccgucuacaacucucgcguggagugcaucgggugguccagcacgucuugucaugauggaaaauccagaaugagcauuugcaucuccggcccuaauaacaaugccucugcuguugugugguauaaccggcgcccggucgccgaaauuaauacaugggcgagaaacauccuccggacccaggagagcgaaugugugugccacaaugggguuugucccguggucuucacagacggauccgccaccggcccugcugauacccgcaucuacuacuuuaaggaggggaagaugcugaaaugggagagccuuacaggaacggccaagcacaacgaagagugcucuugcuauggcgaaagaaccggcauuacauguaccugccgggacaauuggcagggguccaaccgccccgugauccagauugauccuguggcuaugacacauaccagccaauacaucuguucucccguccugacggacaauccgagaccuaacgaucccaauauuggaaaaugcaacgacccuuaucccggcaauaacaacaaugggguuaagggauucagcuaccucgauggcgccaacacauggcuggggcggaccaucuccaccgcgucuagaagcggauaugagaugcuuaaagugcccaaugcccugacagacgaccgcuccaagccuauccagggccagaccauugugcucaacgcugauuggagcggcuacucuggguccuuuauggacuauugggccgaaggagauuguuaccgggcuugcuucuacgucgagcugaucagaggccgcccgaaggaggacaaagugugguggacaagcaauucuauuguuuccauguguagcuccacggaauuucuggggcaguggaacuggcccgauggagccaagaucgaguauuuccucuga

SEQ ID NO: 208165 - RNA, 1398 nt, Artificial Sequence; identical to SEQ ID NO: 206478
  derived and/or modified sequence opt5 from neuraminidase__InfluenzaA__AHM24238

SEQ ID NO: 208166 - RNA, 1398 nt, Artificial Sequence
  derived and/or modified sequence opt5 from neuraminidase__InfluenzaA__AHM24250
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuaccaacauccagauggaggaaagaacaucucggaauuucaacaaucugaccaaggggcuuuguacgauuaacagcuggcacaucuacggaaaagacaaugccguccgcauuggcgagaacuccgauguucuggugaccagagaacccuaugugucuugcgacccugaugagugucgguuuuacgcccucagccaggggacaaccauccgcggaaagcauuccaacggcacaauccacgacagaagccaauaucgggcucugauuucuuggccccuguccagcccucccaccgucuacaauucucgcguggagugcaucggcugguccagcacgucuugucaugaugggaaauccagaaugagcauuugcaucuccggaccuaacaauaacgccucugcuguugugugguauaaucggcgcccggucgccgaaauuaacacaugggcgagaaauauccuccggacccaggagagcgaaugugugugccacaacggcguuugucccguggucuucacagacggguccgccaccggaccugcugauacccgcaucuacuacuuuaaggagggcaagauucugaaaugggagagccuuacagggacggccaagcacaucgaagagugcucuugcuauggagaaagaaccggcauuacauguaccugccgggacaauuggcagggcuccaaccgccccgugauccagauugauccuguggcuaugacacauaccagccaauacaucuguucucccguccugacggacaauccgagaccuaacgaucccaauaucgggaaaugcaacgacccuuaucccggaaauaacaacaauggcguuaagggguucagcuaccucgauggagccaacacauggcugggccggaccauuuccaccgcgucuagaagcggguaugagaugcuuaaagugcccaaugcccugacagacgaccgcuccaagccuauccagggacagaccauugugcucaacgcugauuggagcggcuacucuggcuccuuuauggacuauugggccgaaggggauuguuaccgggcuugcuucuacgucgagcugaucagaggacgcccgaaggaggacaaagugugguggacaagcaauucuauuguuuccauguguagcuccacggaauuucugggccaguggaacuggcccgauggggccaagaucgaguauuuccucuga

SEQ ID NO: 208167 - RNA, 1410 nt, Artificial Sequence; identical to SEQ ID NO: 203733
  derived and/or modified sequence opt5 from neuraminidase__InfluenzaA__AHM98312

SEQ ID NO: 208168 - RNA, 1410 nt, Artificial Sequence
  derived and/or modified sequence opt5 from neuraminidase__InfluenzaA__AHM98331
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggagugcacucugacacaguuggcugguccuggcccgauggggcugagcugccuuucaccaucgacaaauga

SEQ ID NO: 208169 - RNA, 1410 nt, Artificial Sequence; identical to SEQ ID NO: 203749
  derived and/or modified sequence opt5 from neuraminidase__InfluenzaA__AHM98342

SEQ ID NO: 208170 - RNA, 1410 nt, Artificial Sequence
  derived and/or modified sequence opt5 from neuraminidase__InfluenzaA__AHM98353
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcguggaugggagcuguuucaccauuaugacggacggaccgucugauggccaggccagcuacaaaaucuuucgcaucgaaaagggcaaaauugugaaguccgucgagaugaaugcucccaacuaucauuacgaagagugcucuuguuacccugacagcuccgagaucacaugcguuugcagagauaauuggcacgggagcaaccggcccugggugucuuucaaucagaaccuggaauaucagauuggauacaucuguuccggcauuuuuggggacaauccucgccccaacgauaaaaccggaagcugcggcccggugucuuccaauggggccaacggagucaagggcuucagcuuuaaguauggcaaugggguguggaucggaagaacaaaauccauuucuagccggaagggcuucgagaugaucugggacccuaacggguggaccggaaccgacaacaauuuuuccaucaaacaagauauuguuggcaucaacgaauggucuggguacagcggcuccuucgugcagcaucccgagcuuacaggacuggacuguauucgcccuugcuucugggucgaacucaucagaggccggcccaaggagaauacgauuuggaccagcgggucuuccaucagcuuuuguggagugaacucugauacaguuggcugguccuggcccgacggggcugagcugccuuucaccaucgauaaauga

SEQ ID NO: 208171 - RNA, 1410 nt, Artificial Sequence
  derived and/or modified sequence opt5 from neuraminidase__InfluenzaA__AHM98364
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaccuugcgggaaauagcucccugugcccuguuagcggcugggcuauuuacucuaaagacaacuccaucagaaucgggagcaagggagauguguuugucauucgggagccguucaucucuuguagcccccucgaaugccgcaccuuuuuccugacacagggcgcccuucugaaugacaaacauuccaacggcaccauuaaggauagaucuccuuaucggacgcucauguccugucccaucggggaggugccuagccccuacaacucccgcuuugaaucuguugccuggagcgcuuccgccugccacgacggaauuaauuggcugaccaucggcaucagcgggccugauaacggagcuguggccguccugaaauauaauggcauuaucacagacaccauuaagucuuggagaaacaauauccuccggacacaagaguccgagugugcgugcgugaacgggagcuguuucaccauuaugacggauggaccgucugacggccaggccagcuacaagaucuuucgcaucgaaaaaggcaagauugugaaauccgucgagaugaaugcucccaacuaucauuacgaagagugcucuuguuacccugauagcuccgagaucacaugcguuugcagagacaauuggcacgggagcaaccggcccugggugucuuucaaucagaaccuggaauaucagauuggauacaucuguuccggcauuuuuggggauaauccucgccccaacgacaagaccggaagcugcggcccggugucuuccaauggggccaacggagucaaaggcuucagcuuuaaguauggcaacgggguguggaucggaagaacaaaguccauuucuagccggaaaggcuucgagaugaucugggauccuaauggguggaccggaaccgacaacaauuuuuccaucaagcaagacauuguuggcaucaacgaauggucuggguacagcggcuccuucgugcagcaucccgagcuuacaggacuggauuguauucgcccuugcuucugggucgaacucaucagaggccggcccaaagagaauacgauuuggaccagcgggucuuccaucagcuuuuguggagugaacucugacacaguuggcugguccuggcccgauggggcugagcugccuuucaccaucgacaaguga

SEQ ID NO: 208172 - RNA, 1410 nt, Artificial Sequence
  derived and/or modified sequence opt5 from neuraminidase__InfluenzaA__AHM98375
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuuucggacgcucaugucuugucccaucggggaggugccuucccccuauaacagccgcuucgaauccguugccuggucugcuagcgccugccacgacggaauuaauuggcugaccaucggcaucuccgggccugauaacggagcuguggccguccugaaguacaauggcauuaucacagacaccauuaagagcuggagaaacaauauccuccggacacaagagucugagugugcgugcgugaacggguccuguuuuaccauuaugacggauggaccgagcgacggccaggccucuuauaaaaucuuccgcaucgaaaagggcaaaauugucaagagcguggagaugaaugcucccaacuaccauuaugaagagugcuccuguuacccugauucuagcgagaucacaugcguuugcagagacaauuggcacggguccaaccggcccugggugagcuuuaaucagaaccuggaauaccagauuggauauaucuguucuggcauuuucggggauaauccucgccccaacgacaaaaccggauccugcggcccggugagcucuaauggggccaacggagucaagggcuuuuccuucaaguacggcaacgggguguggaucggaagaacaaaaagcauuuccucucggaagggcuuugagaugaucugggauccuaauggguggaccggaaccgacaacaauuucagcaucaaacaagacauuguuggcaucaacgaaugguccggguauucuggcagcuucgugcagcaucccgagcuuacaggacuggauuguauucgcccuugcuuuugggucgaacucaucagaggccggcccaaggagaauacgauuuggaccuccgggagcucuaucuccuucuguggagugaacagcgacacaguuggcuggucuuggcccgauggggcugagcugccuuuuaccaucgacaaauga

SEQ ID NO: 208173 - RNA, 1410 nt, Artificial Sequence; identical to SEQ ID NO: 203733
  derived and/or modified sequence opt5 from neuraminidase__InfluenzaA__AHM98386

SEQ ID NO: 208174 - RNA, 1410 nt, Artificial Sequence
  derived and/or modified sequence opt5 from neuraminidase__InfluenzaA__AHM98408
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggaucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugaaguauaacggcaucauuacagacaccaucaagucuuggagaaauaacauucuccggacacaagaguccgagugugcgugcgucaaugggagcuguuucaccaucaugacggauggaccgucugacggccaggccagcuacaaaaucuuucgcauugaaaagggcaaaaucgugaaguccguggagaugaacgcucccaauuaucauuacgaagagugcucuuguuacccugauagcuccgagauuacaugcgucugcagagacaacuggcacgggagcaaucggcccuggguuucuuucaaccagaaucuggaauaucagaucggauacauuuguuccggcaucuuuggggauaacccucgccccaaugacaaaaccggaagcugcggcccggugucuuccaacggggccaauggagugaagggcuucagcuuuaaguauggcaacggggucuggauuggaagaacaaaauccaucucuagccggaagggcuucgagaugaucugggauccuaacggguggaccggaaccgacaauuccuuuucuauuaaacaagacaucgugggcauuaacgaauggagcggguacuccggcagcuucguucagcaucccgagcuuacaggacuggauuguauccgcccuugcuucuggguggaacucauuagaggccggcccaaggagaauacgaucuggaccucuggguccagcaucucuuuuuguggagucaacuccgacacagugggcuggagcuggcccgauggggcugagcugccuuucaccauugacaaauga

SEQ ID NO: 208175 - RNA, 1410 nt, Artificial Sequence; identical to SEQ ID NO: 208174
  derived and/or modified sequence opt5 from neuraminidase__InfluenzaA__AHM98419

SEQ ID NO: 208176 - RNA, 1410 nt, Artificial Sequence
  derived and/or modified sequence opt5 from neuraminidase__InfluenzaA__AHM98430
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaaacgucauuaccuacgaaaauaacacauggguuaaucagaccuaugugaacaucucuaauacaaacuucgcugccgggcagagcguggucccugugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccauuaugacggauggacccuccgacggccaggccagcuacaaaaucuuucgcaucgaaaagggcaaaauugugaagucugucgagaugaaugcuccuaacuaucauuacgaagagugcagcuguuaccccgauuccucugagaucacaugcguuugcagagacaauuggcacgggagcaaccggccuuggguguccuucaaucagaaccuggaauaucagauuggauacaucuguagcggcauuuuuggggauaauccccgcccgaacgacaaaaccggaucuugcggcccuguguccagcaauggggccaacggagucaagggcuucucuuuuaaguauggcaacgggguguggaucggaagaacaaaauccauuagcucccggaagggcuucgagaugaucugggaucccaauggguggaccggaaccgacaacaauuuuucuaucaaacaagacauuguuggcaucaacgaauggagcggguacuccggcucuuucgugcagcauccugagcuuacaggacuggauuguauucgccccugcuucugggucgaacucaucagaggccggcccaaggagaauacgauuuggaccagcggguccagcaucucuuuuuguggagugaacuccgacacaguuggcuggagcuggccugauggggcugagcugccguucaccaucgacaaauga

SEQ ID NO: 208177 - RNA, 1410 nt, Artificial Sequence; identical to SEQ ID NO: 203981
  derived and/or modified sequence opt5 from neuraminidase__InfluenzaA__AHM98441

SEQ ID NO: 208178 - RNA, 1410 nt, Artificial Sequence
  derived and/or modified sequence opt5 from neuraminidase__InfluenzaA__AHM98452
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucacaugcguuugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggugucuuccaacggcgccaauggggucaagggauucagcuuuaaguauggcaacggcguguggaucgggcggacaaaauccauuucuagccgcaagggauucgagaugaucugggauccuaacggcuggaccgggaccgacaauaacuuuuccaucaaacaagacauuguuggagugaaugaauggucuggcuacagcggguccuucguccagcaucccgagcuuacaggccuggauuguaucagaccuugcuucuggguggaacucauucggggacgccccaaggagaacacgaucuggaccagcggcuccuccauuagcuuuugugggguuaauucugacacagugggaugguccuggcccgauggcgcugagcugccuuucaccaucgacaaauga

SEQ ID NO: 208179 - RNA, 1410 nt, Artificial Sequence; identical to SEQ ID NO: 203733
  derived and/or modified sequence opt5 from neuraminidase__InfluenzaA__AHM98474

SEQ ID NO: 208180 - RNA, 1410 nt, Artificial Sequence
  derived and/or modified sequence opt5 from neuraminidase__InfluenzaA__AHM98485
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuuguuggaaacagcucccugugcccugugagcggcugggcgauuuacucuaaggacaauuccaucagaaucgggagcaaaggagaugucuuugugauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggagguuccuagccccuacaacucccgcuuugaaucuguggcuuggagcgccuccgcuugccacgacggaauuaacuggcugaccaucggcaucagcgggccugauaauggagccgucgcugugcugaaguauaacggcauuaucacagacaccauuaagucuuggagaaauaacauccuccggacacaagaguccgagugugccugcgugaaugggagcuguuucaccauuaugacggauggaccgucugacggccaggcgagcuacaaaaucuuucgcaucgaaaagggcaaaauugucaaguccguugagaugaacgcccccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggcuaauggagugaagggcuucagcuuuaaguauggcaacgggguuuggaucggaagaacaaaauccauuucuagccggaagggcuucgagaugaucugggauccuaacggguggaccggaaccgacaauaacuuuuccaucaaacaagacauugugggcaucaaugaauggucuggguacagcggcuccuucguccagcaucccgagcuuacaggacuggauuguauucgcccuugcuucuggguggaacucaucagaggccggcccaaggagaacacgauuuggaccagcgggucuuccaucagcuuuuguggaguuaauucugacacagugggcugguccuggcccgauggggccgagcugccuuucaccaucgacaaauga

SEQ ID NO: 208181 - RNA, 1410 nt, Artificial Sequence
  derived and/or modified sequence opt5 from neuraminidase__InfluenzaA__AHM98496
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaaaacagaagcccuuaucggacgcucaugucuugucccaucggggaggugccuucccccuacaauagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccauuaugacggacggaccgagcgauggccaggccucuuacaaaaucuuucgcaucgaaaagggcaaaauugucaagagcguggagaugaacgcucccaauuaucauuacgaagagugcuccuguuacccugacucuagcgagaucaaaugcguuugcagagauaacuggcacggguccaaucggcccugggugagcuucaaccagaaucuggaauaucagauuggauacaucuguucuggcauuuuuggggacaacccucgccccaaugauaagacaggauccugcggcccggugagcucuaacggggccaacggagucaagggcuucuccuuuaaauauggcaaugggguguggaucggaagaaccaagagcauuuccucucggaaaggcuucgagaugaucugggacccuaacggguggacaggaaccgauaauaacuuuagcaucaagcaagacauuguuggcaucaaugaaugguccggguacucuggcagcuucgugcagcaucccgagcuuaccggacuggacuguauucgcccuugcuucugggucgaacucaucagaggccggcccaaagagaacacaauuuggacguccgggagcucuaucuccuuuuguggagugaauagcgauaccguuggcuggucuuggcccgacggggcugagcugccuuucacaaucgauaaguga

SEQ ID NO: 208182 - RNA, 1410 nt, Artificial Sequence; identical to SEQ ID NO: 203733
  derived and/or modified sequence opt5 from neuraminidase__InfluenzaA__AHM98507

SEQ ID NO: 208183 - RNA, 1410 nt, Artificial Sequence
  derived and/or modified sequence opt5 from neuraminidase__InfluenzaA__AHM98518
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggaucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugaaguauaacggcaucauuacagacaccaucaagucuuggagaaauaacauucuccggacacaagaguccgagugugcgugcgucaaugggagcuguuucaccaucaugacggauggaccgucugacggccaggccagcuacaaaaucuuucgcauugaaaagggcaaaaucgugaaguccguggagaugaacgcucccaauuaucauuacgaagagugcucuuguuacccugauagcuccgagauuacaugcgucugcagagacaacuggcacgggagcaaucggcccuggguuucuuucaaccagaaucuggaauaucagaucggauacauuuguuccggcaucuuuggggauaacccucgccccaaugacaaaaccggaagcugcggcccggugucuuccaacggggccaauggagugaagggcuucagcuuuaaguauggcaacggggucuggauuggaagaacaaaauccaucucuagccggaagggcuucgagaugaucugggauccuaacggguggaccggaaccgacaauaacuuuuccauuaaacaagacaucgugggcauuaaugaauggucuggguacagcggcuccuucguucagcaucccgagcuuacaggacuggauuguauccgcccuugcuucuggguggaacucauuagaggccggcccaaggagaacacgaucuggaccagcgggucuuccaugagcuuuuguggagucaauucugacacagugggcugguccuggcccgauggggcugagcugccuuucaccaucgacaaauga

SEQ ID NO: 208184 - RNA, 1410 nt, Artificial Sequence; identical to SEQ ID NO: 203281
  derived and/or modified sequence opt5 from neuraminidase__InfluenzaA__AHM98529

SEQ ID NO: 208185 - RNA, 1410 nt, Artificial Sequence; identical to SEQ ID NO: 204025
  derived and/or modified sequence opt5 from neuraminidase__InfluenzaA__AHM98540

SEQ ID NO: 208186 - RNA, 1410 nt, Artificial Sequence
  derived and/or modified sequence opt5 from neuraminidase__InfluenzaA__AHM98562
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaagccggauccugcggcccggugagcucuaauggggcuaacggagucaagggcuucuccuuuaaguauggcaacgggguguggaucggaagaaccaaaagcauuuccucucggaagggcuucgagaugaucugggauccuaauggguggacaggaaccgacaacaauuuuagcaucaaacaagacauuguuggcaucaacgaaugguccggguacucuggcagcuucgugcagcaucccgagcuuaccggacuggauuguauucgcccuugcuucugggucgaacucaucagaggccggcccaaggagaauacaauuuggacguccgggagcucuaucuccuuuuguggagugaacagcuauaccguuggcuggucuuggcccgacggggccgagcugccuuucacaaucgauaaauga

SEQ ID NO: 208187 - RNA, 1410 nt, Artificial Sequence; identical to SEQ ID NO: 208176
  derived and/or modified sequence opt5 from neuraminidase__InfluenzaA__AHM98573

SEQ ID NO: 208188 - RNA, 1410 nt, Artificial Sequence
  derived and/or modified sequence opt5 from neuraminidase__InfluenzaA__AHM98584
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggaucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugagauauaacggcaucauuacagacaccaucaagucuuggcggaauaacauucuccgcacacaagaguccgagugugcgugcgucaaugggagcuguuucaccaucaugacggauggaccgucugacggccaggccagcuacaagaucuuuagaauugaaaaaggcaagaucgugaaauccguggagaugaacgcucccaauuaucauuacgaagagugcucuuguuacccugauagcuccgagauuacaugcgucugccgggacaacuggcacgggagcaaucgccccuggguuucuuucaaccagaaucuggaauaucagaucggauacauuuguuccggcaucuuuggggauaacccuagacccaaugacaagaccggaagcugcggcccggugucuuccaacggggccaauggagugaaaggcuucagcuuuaaguauggcaacggggucuggauuggacggacaaaguccaucucuagccgcaaaggcuucgagaugaucugggauccuaacggguggaccggaaccgacaauuccuuuucuauuaagcaagacaucgugggcauuaacgaauggagcggguacuccggcagcuucguucagcaucccgagcuuacaggacuggauuguaucagaccuugcuucuggguggaacucauucggggccgccccaaagagaauacgaucuggaccucuggguccagcaucucuuuuuguggagucaacuccgacacagugggcuggagcuggcccgauggggcugagcugccuuucaccauugacaaguga

SEQ ID NO: 208189 - RNA, 1410 nt, Artificial Sequence; identical to SEQ ID NO: 208176
  derived and/or modified sequence opt5 from neuraminidase__InfluenzaA__AHM98595

SEQ ID NO: 208190 - RNA, 1410 nt, Artificial Sequence; identical to SEQ ID NO: 203733
  derived and/or modified sequence opt5 from neuraminidase__InfluenzaA__AHM98606

SEQ ID NO: 208191 - RNA, 1410 nt, Artificial Sequence
  derived and/or modified sequence opt5 from neuraminidase__InfluenzaA__AHM98617
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggaucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucggcugccgcaccuuuuuccugacacagggcgcccuucugaacgacaagcauagcaaugggaccaucaaagauagaucuccuuaucggacgcucauguccugucccauuggagaagucccuagccccuacaacucccgcuuugagucuguggccuggagcgcuuccgccugccacgacggcaucaacuggcugaccaucgggauuagcggaccugauaauggcgcuguugccgugcugaaguauaacgggaucauuacagacaccaucaagucuuggagaaauaacauucuccggacacaagaauccgagugugcgugcgucaauggaagcuguuucaccaucaugacggauggcccgucugacggccaggccagcuacaaaaucuuucgcauugagaaggggaaaaucgugaaguccguggaaaugaacgcucccaauuaucauuacgaggaaugcucuuguuacccugauagcuccgagauuacaugcgucugcagagacaacuggcacggaagcaaucggcccuggguuucuuucaaccagaaucuggaguaucagaucggcuacauuuguuccgggaucuuuggagauaacccucgccccaaugacaaaaccggcagcugcgggccggugucuuccaacggagccaauggcgugaagggcuucagcuuuaaguaugggaacggagucuggauuggcagaacaaaauccaucucuagccggaagggguucgaaaugaucugggauccuaacggauggaccggcaccgacaauuccuuuucuauuaaacaagacaucguggggauuaacgaguggagcggcuacuccggauccuucguucagcaucccgaacuuacaggccuggauuguauccgcccuugcuucuggguggagcucauuagagggcggcccaaggaaaauacgaucuggaccucuggauccagcaucucuuuuuguggcgucaacuccgacacagugggguggagcuggcccgauggagcugagcugccuuucaccauugacaaauga

SEQ ID NO: 208192 - RNA, 1410 nt, Artificial Sequence; identical to SEQ ID NO: 208174
  derived and/or modified sequence opt5 from neuraminidase__InfluenzaA__AHM98628

SEQ ID NO: 208193 - RNA, 1410 nt, Artificial Sequence
  derived and/or modified sequence opt5 from neuraminidase__InfluenzaA__AHM98639
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaucuacgaaaacaauaccuggauuaaccagacauauguuaauaucagcaacaccaauuucgcugccgagcaguccguggugucugucaaacuugcggggaacagcucccugugcccugugagcggaugggcuaucuacucuaaggacaauuccauuagaaucggcagcaaaggggauguuuuugugauucgggaaccguucaucucuuguagcccccucgagugccgcacauuuuuccugacccagggagcccuucugaacgacaagcauuccaauggcacaauuaaagauagaucuccuuaucggacccucauguccugucccaucggcgaagucccuagccccuacaacucccgcuuugagucuguggccuggagcgcuuccgccugccacgacgggaucaacuggcugacgauuggaaucagcggcccugauaauggggcuguugccgugcugaaguauaacggaauuaucaccgacacaauuaagucuuggagaaauaacauccuccggacccaagaguccgaaugugcgugcgucaauggcagcuguuucacaaucaugaccgaugggccgucugacggacaggccagcuacaaaauuuuucgcaucgagaagggcaaaauugugaaguccguggaaaugaacgcucccaauuaucauuacgaggagugcucuuguuacccugauagcuccgaaaucacgugcgucugcagagacaacuggcacggcagcaaucggcccuggguuucuuucaaccagaaucuggaguaucagauuggguacaucuguuccggaauuuuuggcgauaacccucgccccaaugacaaaacagggagcugcggaccggugucuuccaacggcgccaauggggugaagggauucagcuuuaaguauggcaacggcgucuggaucgggagaaccaaauccaucucuagccggaagggauucgaaaugauuugggauccuaacggcuggacagggaccgacaauuccuuuucuaucaaacaagacauugugggaaucaacgaguggagcggcuacuccgggagcuucguucagcaucccgaacuuaccggccuggauuguauucgcccuugcuucuggguggagcucaucagaggacggcccaaggagaauacaaucuggacgucuggcuccagcauuucuuuuuguggggucaacuccgacaccgugggauggagcuggcccgauggcgcugaacugccuuucacaaucgacaaauga

SEQ ID NO: 208194 - RNA, 1410 nt, Artificial Sequence; identical to SEQ ID NO: 203733
  derived and/or modified sequence opt5 from neuraminidase__InfluenzaA__AHM98650

SEQ ID NO: 208195 - RNA, 1410 nt, Artificial Sequence; identical to SEQ ID NO: 203733
  derived and/or modified sequence opt5 from neuraminidase__InfluenzaA__AHM98661

SEQ ID NO: 208196 - RNA, 1410 nt, Artificial Sequence
  derived and/or modified sequence opt5 from neuraminidase__InfluenzaA__AHM98672
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaaacgucauuaccuacgaaaauaacacauggguuaaucagaccuaugugaacaucucuaauacaaacuucgcugccgagcagagcguggucccugugaaacuugcgggaaauuccucucugugcccgguuagcgggugggcuauuuacuccaaggacaacagcaucagaaucggcucuaaaggggauguguuugucauucgggaacccuucaucuccuguagcccucucgagugccgcaccuuuuuccugacacagggagcccuucugaaugacaagcauucuaacggcaccauuaaagauagaucccccuaucggacgcucaugagcuguccuaucggcgaagugcccucuccuuacaacucccgcuuugagagcguugccugguccgcuucugccugccacgacgggauuaauuggcugaccaucggaaucagcggcccggauaacggggcuguggccguccugaaguauaauggaauuaucacagacaccauuaaguccuggagaaacaauauccuccggacacaagagagcgaaugugcgugcgugaacggcucuuguuucaccauuaugacggaugggcccuccgacggacaggccagcuacaaaaucuuucgcaucgagaagggcaaaauugugaagucugucgaaaugaaugcuccuaacuaucauuacgaggagugcagcuguuaccccgauuccucugaaaucacaugcguuugcagagacaauuggcacggcagcaaccggccuuggguguccuucaaucagaaccuggaguaucagauuggguacaucuguagcggaauuuuuggcgauaauccccgcccgaacgacaaaaccgggucuugcggaccuguguccagcaauggcgccaacggggucaagggauucucuuuuaaguauggcaacggcguguggaucgggagaacaaaauccauuagcucccggaagggauucgaaaugaucugggaucccaauggcuggaccgggaccgacaacaauuuuucuaucaaacaagacauuguuggaaucaacgaguggagcggcuacuccgggucuuucgugcagcauccugaacuuacaggccuggauuguauucgccccugcuucugggucgagcucaucagaggacggcccaaggagaauacgauuuggaccagcggcuccagcaucucuuuuuguggggugaacuccgacacaguuggauggagcuggccugauggcgcugaacugccguucaccaucgacaaauga

SEQ ID NO: 208197 - RNA, 1410 nt, Artificial Sequence
  derived and/or modified sequence opt5 from neuraminidase__InfluenzaA__AHM98683
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgacgcugggcagagcguggucuccgugagacuugccggaaauucuagccugugcccuguuuccggcugggcgauuuacagcaaagauaacucuauccggaucggguccaagggagacguguuugucauucgcgagccguucaucagcuguucuccccucgaaugcagaaccuuuuuccugacacagggcgcccuucugaaugauaaacauuccaacggcaccauuaaggaccggagcccuuaucgcacgcucaugucuugucccaucggggaggugccuucccccuacaacagcagauuugaauccguugcuuggucugccagcgcuugccacgauggauucaauuggcugaccauuggcaucuccgggccugacaacggagccguggcuguccugaaauauaauggcaucauuacagauaccauccggagcuggcgcaacaauauucucagaacacaagagucugagugugccugcgugaacggguccuguuuuaccaucaugacggacggaccgagcgauggccaggcgucuuacaagauuuuccggaucgaaaagggcaaaaucgucaagagcguggagaugaaugcccccaacuaucauuacgaagagugcuccuguuacccugacucuagcgagauuacaugcguuugccgcgauaauuggcacggguccaacagacccugggugagcuuuaaucagaaccuggaauaucagaucggauacauuuguucuggcaucuucggggacaauccucggcccaacgauaaaaccggauccugcggcccggugagcucuaauggggcuaacggagucaagggcuuuuccuucaaauauggcaacgggguguggauuggacgcacaaagagcaucuccucuagaaagggcuuugagaugauuugggacccuaauggguggaccggaaccgacaacaauuucagcaucaaacaagauaucguuggcauuaacgaaugguccggguacucuggcagcuucgugcagcaucccgagcuuacaggacuggacuguauccggccuugcuuuugggucgaacucauucgcggcagacccaaggagaauacgaucuggaccuccgggagcucuauuuccuucuguggagugaacagcgauacaguuggcuggucuuggcccgacggggccgagcugccuuuuaccaucgauaaauga

SEQ ID NO: 208198 - RNA, 1410 nt, Artificial Sequence; identical to SEQ ID NO: 203733
  derived and/or modified sequence opt5 from neuraminidase__InfluenzaA__AHM98693

SEQ ID NO: 208199 - RNA, 1410 nt, Artificial Sequence; identical to SEQ ID NO: 206182
  derived and/or modified sequence opt5 from neuraminidase__InfluenzaA__AHM98704

SEQ ID NO: 208200 - RNA, 1410 nt, Artificial Sequence; identical to SEQ ID NO: 206182
  derived and/or modified sequence opt5 from neuraminidase__InfluenzaA__AHM98715

SEQ ID NO: 208201 - RNA, 1410 nt, Artificial Sequence; identical to SEQ ID NO: 203733
  derived and/or modified sequence opt5 from neuraminidase__InfluenzaA__AHM98726

SEQ ID NO: 208202 - RNA, 1410 nt, Artificial Sequence
  derived and/or modified sequence opt5 from neuraminidase__InfluenzaA__AHM98737
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaacuacgaaaauaacaccuggguuaaucagacauaugugaacaucagcaauaccaacuucgcugccggccaguccguggucucugugaaacuugcggggaauagcucccugugcccuguuagcggaugggcuauuuacucuaaggacaacuccauccggaucggcagcaaaggggauguguuugucauucgcgagccguucgugucuuguucuccccucgaaugcagaacauuuuuccugacccagggagcccuucugaaugacaagcauagcaacggcacaaucaaagaucggucuccuuaucgcacccucauguccugucccauuggcgagguuccuagccccuacaacuccagauuugaaucuguggccuggagcgcuuccgccugccacgacgggaucaauuggcugacgauuggaaucagcggcccugauaacggggcugucgccgugcugaaguauaauggaaucauuaccgacacaaucaagucuuggcggaacgauauucuccgcacccaagaguccgagugugcgugcgugaauggcagcuguuucacaaucaugaccgacgggccgucugauggacaggccagcuacaaaauuuuuagaaucgaaaagggcaaaaucgucaaguccguugagaugaacgcucccaauuaucauuacgaagagugcucuuguuacccugacagcuccgagauuacgugcgugugccgggauaacuggcacggcagcaaucgccccugggugucuuucaaccagaaucuggaauaucagaucggguacauuuguuccggaaucuuuggcgacaacccuagacccaaugauaaaacagggagcugcggaccggucucuuccaacggcgccaauggggugaagggauucagcuuuaaguauggcaacggcguuuggauugggcggaccaaauccaucucuagccgcaagggauucgagaugauuugggacccuaacggcuggacagggaccgacaauaacuuuuccaucaaacaagauaucgugggaauuaaugaauggucuggcuacagcggguccuucguccagcaucccgagcuuaccggccuggacuguaucagaccuugcuucuggguggaacucauucggggacgccccaaggagaacacaaucuggacgagcggcuccuccauuagcuuuugugggguuaauucugauaccgugggaugguccuggcccgacggcgcugagcugccuuucacaaucgauaaauga

SEQ ID NO: 208203 - RNA, 1410 nt, Artificial Sequence; identical to SEQ ID NO: 206182
  derived and/or modified sequence opt5 from neuraminidase__InfluenzaA__AHM98748

SEQ ID NO: 208204 - RNA, 1410 nt, Artificial Sequence; identical to SEQ ID NO: 206182
  derived and/or modified sequence opt5 from neuraminidase__InfluenzaA__AHM98759

SEQ ID NO: 208205 - RNA, 1410 nt, Artificial Sequence
  derived and/or modified sequence opt5 from neuraminidase__InfluenzaA__AHM98770
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugcuauuaccuacgaaaacaauacaugggucaaccagaccuauguuaauaucagcaacacaaauuucgccgcgggccaguccguggugucugucaaacuugcugggaacagcucccugugcccugugagcggaugggccauuuacucuaaggacaauuccauccggaucggcagcaaaggggauguuuuugugauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggucccuagccccuacaacuccagauuugaaucuguggcuuggagcgccuccgcuugccacgacgggauuaacuggcugaccaucggaaucagcggcccugauaauggggccguugcggugcugaaguauaacggaauuaucacagacaccauuaagucuuggcggaauaacauccuccgcacacaagaguccgagugugccugcgucaauggcagcuguuucaccauuaugacggaugggccgucugacggacaggcuagcuacaaaaucuuuagaaucgaaaagggcaaaauugugaaguccguggagaugaacgcccccaauuaucauuacgaagagugcucuuguuacccugauagcuccgagaucacaugcgucugccgggacaacuggcacggcagcaaucgccccuggguuucuuucaaccagaaucuggaauaucagauuggguacaucuguuccggaauuuuuggcgauaacccuagacccaaugacaaaaccgggagcugcggaccggugucuuccaacggcgcuaauggggugaagggauucagcuuuaaguauggcaacggcgucuggaucgggcggacaaaauccauuucuagccgcaagggauucgagaugaucugggauccuaacggcuggaccgggaccgacaauaacuuuuccaucaaacaagacauugugggaaucaaugaauggucuggcuacagcggguccuucguucagcaucccgagcuuacaggccuggauuguauuagaccuugcuucuggguggaacucauccggggacgccccaaggagaacacgauuuggaccagcggcuccuccaucagcuuuuguggggucaauucugacacagugggaugguccuggcccgauggcgccgagcugccuuucaccaucgacaaauga

SEQ ID NO: 208206 - RNA, 1410 nt, Artificial Sequence
  derived and/or modified sequence opt5 from neuraminidase__InfluenzaA__AHM98781
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccuccgacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauuccuuuucuaucaaacaagacauuguuggcaucaacgaauggagcggguacuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaacuccggcacaguuggguggagcuggcccgacggagcugagcugccuuucaccaucgauaaauga

SEQ ID NO: 208207 - RNA, 1410 nt, Artificial Sequence; identical to SEQ ID NO: 203733
  derived and/or modified sequence opt5 from neuraminidase__InfluenzaA__AHM98801

SEQ ID NO: 208208 - RNA, 1410 nt, Artificial Sequence; identical to SEQ ID NO: 203281
  derived and/or modified sequence opt5 from neuraminidase__InfluenzaA__AHM98812

SEQ ID NO: 208209 - RNA, 1410 nt, Artificial Sequence
  derived and/or modified sequence opt5 from neuraminidase__InfluenzaA__AHM98823
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuauaucaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguucccccagcgaaugccgcaccuuuuuccucacacagggcgcccugcuuaacgacaagcauucuaauggcaccaucaaagauagauccccuuaucggacgcugaugagcugucccauuggggaggucccuucccccuacaacucucgcuuugaaagcguggccugguccgcuagcgccugccacgacggaaucaacuggcucaccaucggcauuucugggccugauaauggagcuguugccgugcugaaguauaacggcaucauuacagacaccaucaaguccuggagaaauaacauucugcggacacaagagagcgagugugcgugcgucaaugggucuuguuucaccaucaugacggauggaccgagcgacggccaggccuccuacaaaaucuuucgcauugaaaagggcaaaaucgugaagucuguggagaugaacgcucccaauuaucauuacgaagagugcagcuguuacccugauuccagcgagauuacaugcgucugcagagacaacuggcacgggucuaaucggcccuggguuuccuucaaccagaaucucgaauaucagaucggauacauuuguagcggcaucuuuggggauaacccucgccccaaugacaaaaccggaucuugcggcccgguguccagcaacggggccaauggagugaagggcuucuccuuuaaguauggcaacggggucuggauuggaagaacaaaaucuaucagcucccggaagggcuucgagaugaucugggauccuaacggguggaccggaaccgacaauaacuuuucuauuaaacaagacaucgugggcauuaaugaauggagcggguacuccggcagcuucguucagcaucccgagcugacaggacuugauuguauccgcccuugcuucuggguggaacugauuagaggccggcccaaggagaacacgaucuggaccucuggguccagcaucucuuuuuguggagucaauuccgacacagugggcuggagcuggcccgauggggcugagcucccuuucaccauugacaaauga

SEQ ID NO: 208210 - RNA, 1410 nt, Artificial Sequence
  derived and/or modified sequence opt5 from neuraminidase__InfluenzaA__AHM98839
augaaccccaaucagaagaucauuaccaucggcagcgugugcaugacagucgggauggccaaccugauucuccaaaucggaaauauuaucuccaucuggauuucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccauuagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauaauggagcugucgccgugcugaaguauaacggcaucauuacagacaccaucaagucuuggagaaauaacauucuccggacacaagaguccgagugugcgugcgugaaugggagcuguuucaccaucaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaagggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 208211 - RNA, 1410 nt, Artificial Sequence; identical to SEQ ID NO: 203281
  derived and/or modified sequence opt5 from neuraminidase__InfluenzaA__AHM98850

SEQ ID NO: 208212 - RNA, 1410 nt, Artificial Sequence; identical to SEQ ID NO: 203281
  derived and/or modified sequence opt5 from neuraminidase__InfluenzaA__AHM98861

SEQ ID NO: 208213 - RNA, 1410 nt, Artificial Sequence
  derived and/or modified sequence opt5 from neuraminidase__InfluenzaA__AHM98901
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccucaccggacgcucaugucuugucccaucggggaggugccuucccccuauaacagccgcuuugaauccguugccuggucugcuagcgccugccaugacggaauuaauuggcugaccaucggcaucuccgggccugauaacggagcuguggccguccugaaguacaauggcauuaucacagacaccauuaagagcuggagaaacaauauccuccggacacaagagucugagugugcgugcgugaacggguccuguuucaccauuaugacggauggaccgagcgacggccaggccucuuauaaaaucuuucgcaucgaaaagggcaaaauugucaagagcguggagaugaaugcucccaacuaccacuaugaagagugcuccuguuacccugauucuagcgagaucacaugcguuugcagagacaauuggcauggguccaaccggcccugggugagcuucaaucagaaccuggaauaccagauuggauauaucuguucuggcauuuuuggggauaauccucgccccaacgacaaaaccggauccugcggcccggugagcucuaauggggccaacggagucaagggcuucuccuuuaaguacggcaacgggguguggaucggaagaacaaaaagcauuuccucucggaagggcuucgagaugaucugggauccuaauggguggaccggaaccgacaacaauuuuagcaucaaacaagacauuguuggcaucaacgaaugguccggguauucuggcagcuucgugcagcaccccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 208214 - RNA, 1410 nt, Artificial Sequence; identical to SEQ ID NO: 206870
  derived and/or modified sequence opt5 from neuraminidase__InfluenzaA__AHM98912

SEQ ID NO: 208215 - RNA, 1410 nt, Artificial Sequence; identical to SEQ ID NO: 206870
  derived and/or modified sequence opt5 from neuraminidase__InfluenzaA__AHM98923

SEQ ID NO: 208216 - RNA, 1410 nt, Artificial Sequence; identical to SEQ ID NO: 206870
  derived and/or modified sequence opt5 from neuraminidase__InfluenzaA__AHM98935

SEQ ID NO: 208217 - RNA, 1410 nt, Artificial Sequence; identical to SEQ ID NO: 206870
  derived and/or modified sequence opt5 from neuraminidase__InfluenzaA__AHM98943

SEQ ID NO: 208218 - RNA, 1410 nt, Artificial Sequence; identical to SEQ ID NO: 206870
  derived and/or modified sequence opt5 from neuraminidase__InfluenzaA__AHM98954

SEQ ID NO: 208219 - RNA, 1410 nt, Artificial Sequence; identical to SEQ ID NO: 206870
  derived and/or modified sequence opt5 from neuraminidase__InfluenzaA__AHM98972

SEQ ID NO: 208220 - RNA, 1410 nt, Artificial Sequence; identical to SEQ ID NO: 206870
  derived and/or modified sequence opt5 from neuraminidase__InfluenzaA__AHM98978

SEQ ID NO: 208221 - RNA, 1410 nt, Artificial Sequence; identical to SEQ ID NO: 206870
  derived and/or modified sequence opt5 from neuraminidase__InfluenzaA__AHM98990

SEQ ID NO: 208222 - RNA, 1410 nt, Artificial Sequence; identical to SEQ ID NO: 206870
  derived and/or modified sequence opt5 from neuraminidase__InfluenzaA__AHM99000

SEQ ID NO: 208223 - RNA, 1410 nt, Artificial Sequence; identical to SEQ ID NO: 206870
  derived and/or modified sequence opt5 from neuraminidase__InfluenzaA__AHM99011

SEQ ID NO: 208224 - RNA, 1410 nt, Artificial Sequence; identical to SEQ ID NO: 206846
  derived and/or modified sequence opt5 from neuraminidase__InfluenzaA__AHM99022

SEQ ID NO: 208225 - RNA, 1410 nt, Artificial Sequence; identical to SEQ ID NO: 206846
  derived and/or modified sequence opt5 from neuraminidase__InfluenzaA__AHM99034

SEQ ID NO: 208226 - RNA, 1410 nt, Artificial Sequence; identical to SEQ ID NO: 206846
  derived and/or modified sequence opt5 from neuraminidase__InfluenzaA__AHM99046

SEQ ID NO: 208227 - RNA, 1410 nt, Artificial Sequence; identical to SEQ ID NO: 206846
  derived and/or modified sequence opt5 from neuraminidase__InfluenzaA__AHM99057

SEQ ID NO: 208228 - RNA, 1410 nt, Artificial Sequence; identical to SEQ ID NO: 206846
  derived and/or modified sequence opt5 from neuraminidase__InfluenzaA__AHM99068

SEQ ID NO: 208229 - RNA, 1410 nt, Artificial Sequence; identical to SEQ ID NO: 206870
  derived and/or modified sequence opt5 from neuraminidase__InfluenzaA__AHM99078

SEQ ID NO: 208230 - RNA, 1410 nt, Artificial Sequence
  derived and/or modified sequence opt5 from neuraminidase__InfluenzaA__AHN00720
augaacaccaaucagagaaucauuacaaucggcacgauuugccugaucguggggauuaucagccuccugcuucaaaucggaaacauugucucccuguggaucucucacagcauucagaccgaggaaaagucccaucccgagguuuguaaucagucugugaucacauacgaaaacaauaccugggugaaccagacauauauuaauaucagcaacaccaauauugccgcuggccaaggggucacaccuaucauccucgccggaaacuccucucugugcccgauuagcggcugggcgaucuacuccaaagacaauagcauucggaucgggucuaagggagauauuuucgugaugcgcgagcccuuuaucuccuguagccaccuugaaugcagaaccuucuuucugacgcagggcgcucuccugaacgaccggcauucuaauggcaccguuaaagaucgcuccccuuauagaacacugaugagcugucccaucggggaggccccuucucccuacaacucccgguucgagagcguggccugguccgcuucugccugccacgacggaaugggcuggcucaccauugggaucagcggaccugauaauggcgcugucgccgugcugaaguauaacgggauuaucacagacaccaugaaauccuggcgcaacaagauucuuagaacgcaggaaagcgaguguguuugcaucaauggaucuuguuuuacaaucaugaccgauggcccguccaacggccaggcgagcuacaagauuuucaaaauggaaaaggggaaaaucauuaagucuaucgagcuggacgcccccaauuaucauuacgaggaaugcagcuguuacccugauacaggaaaaguggucugcgugugccgggacaacuggcacgcuuccaaucgccccugggugucuuuugaucaaaaccucgacuaucagauuggcuacaucuguagcggggucuucggagauaauccuagauccaacgacggcaaggggaauugcggacccguucugagcaacggcgccaauggcgugaagggguuuucuuuccgguauggaaacggcguguggauugggcgcaccaaauccaucagcucuagauccggauuugagaugaucugggacccgaauggcuggaccgaaacagauagcuccuucucuaugaagcaggacauuaucgcucuuacggauuggagcggguacuccggcucuuuuguccagcacccugagcugaccggaaugaacuguauucggcccugcuucuggguggaacucauccgcggccaaccuaaagagagcacaauuuggaccuccgggagcucuaucuccuucuguggaguuaauagcgagacagccucuugguccuggcccgacggcgcggaucugcccuuuaccaucgacaaguga

SEQ ID NO: 208231 - RNA, 1410 nt, Artificial Sequence
  derived and/or modified sequence opt5 from neuraminidase__InfluenzaA__AHN00767
augaacaccaaucagagaaucauuacaaucggcacgauuugccugaucguggggauuaucagccuccugcuucaaaucggaaacauugucucccuguggaucucucacagcauucagaccggcgagaagucccaucccgaaguuuguaaucagucugugaucacauacgagaacaauaccugggugaaccagacauaugucaauauuagcaacaccaauaucgccgcugggcaaggagugacaccuauuauccucgccggcaacuccucucugugcccgaucagcgggugggcgauuuacuccaaagacaauagcauccggauuggaucuaagggcgauaucuucguuaugcgcgaacccuuuauuuccuguagccaccuugagugcagaaccuucuuucugacgcagggcgcucuccugaacgaccggcauucuaaugggaccgugaaagaucgcuccccuuauagaacacugaugagcugucccaucggagaagccccuucucccuacaacucccgguucgagagcgucgccugguccgcuucugccugccacgacggcaugggguggcucaccaucggaauuagcggcccugauaauggggcuguggccguucugaaguauaacggaaucauuacagacaccaucaaauccuggcgcaacaagauucuuagaacgcaggagagcgaaugugugugcaucaauggcucuuguuuuacaaucaugaccgauggcccguccaacgggcaggcgagcuacaagauuuucaaaauggagaagggaaaaaucauuaagucuaucgaacuggacgcccccaauuaucauuacgaggagugcagcuguuacccugauacaggcaaagucgugugcgugugccgggacaacuggcacgcuuccaaucgccccugggucucuuuugaucaaaaccucgacuaucagauuggguacaucuguagcggaguuuucggcgauaauccuagauccaacgacgggaagggaaauugcggccccgugcugagcaacggcgccaauggggugaagggauuuucuuuccgguauggcaacggggucuggauuggacgcaccaaauccaucagcucuagauccggcuuugaaaugaucugggacccgaauggguggaccgagacagauagcuccuucucuaugaagcaggacauuaucgcucuuacggauuggagcggcuacuccggaucuuuugugcagcacccugaacugaccggcaugaacuguauucggcccugcuucuggguugagcucauccgcgggcaaccuaaagaaagcacaauuuggaccuccggaagcucuaucuccuucuguggcgugaauagcgagacagccucuugguccuggcccgacggggcggaucugcccuuuaccaucgacaaguga

SEQ ID NO: 208232 - RNA, 1398 nt, Artificial Sequence
  derived and/or modified sequence opt5 from neuraminidase__InfluenzaA__AHN96324
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuaccaacauccagauggaggaaagaacaucucggaauuucaacaaucugaccaaggggcuuuguacgauuaacagcuggcacaucuacggaaaagacaaugccguccgcauuggcgaguccucugauguucuggugaccagagaacccuaugugagcugcgacccugaugagugucgguuuuacgcccucucccaggggacaaccauccgcggaaagcauagcaacggcacaauccacgacagaucucaauaucgggcucugauuuccuggccccugagcucuccucccaccgucuacaacucccgcguggagugcaucggcuggagcucuacguccugucaugaugggaaaagcagaauguccauuugcaucucuggaccuaauaacaaugccagcgcuguugugugguauaaccggcgcccggucgccgaaauuaauacaugggcgagaaacauccuccggacccaggaguccgaaugugugugccacaauggcguuugucccguggucuucacagacgggagcgccaccggaccugcugauacccgcaucuacuacuuuaaggagggcaagauucugaaaugggagucucuuacagggacggccaagcacaucgaagagugcuccugcuauggagaaagaaccggcauuacauguaccugccgggacaacuggcagggcagcaaucgccccguggugcagaucgauccugucgcuaugacacauaccucucaauacauuuguagccccguucugacggacaacccgagaccuaaugaucccaacaucgggaaaugcaaugacccuuaucccggaaacaauaacaacggcgugaagggguucuccuaccucgauggagccaauacauggcugggccggaccaucucuaccgcgagcagauccggguaugagaugcuuaaagugcccaacgcccugacagacgaccgcagcaagccuauucagggacagaccaucguccucaaugcugauuggucuggcuacuccggcagcuuuauggacuauugggccgaaggggauuguuaccgggcuugcuucuacguggagcugauuagaggacgcccgaaggaggacaaaguuugguggacaucuaacuccaucgugagcauguguuccucuacggaauuucugggccaguggaauuggcccgauggggccaagauugaguauuuccucuga

SEQ ID NO: 208233 - RNA, 1410 nt, Artificial Sequence; identical to SEQ ID NO: 204167
  derived and/or modified sequence opt5 from neuraminidase__InfluenzaA__AHN96448

SEQ ID NO: 208234 - RNA, 1410 nt, Artificial Sequence; identical to SEQ ID NO: 205170
  derived and/or modified sequence opt5 from neuraminidase__InfluenzaA__AHN96450

SEQ ID NO: 208235 - RNA, 1410 nt, Artificial Sequence
  derived and/or modified sequence opt5 from neuraminidase__InfluenzaA__AHN96451
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucauguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugugucuugcgacccggauaaguguuaccaauucgcucugggacagggcaccacacuuaauaacguccauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuaucguuguguucugugggaccagcggaacauacggcacgggguccuggccugauggcgcugaccucaaccugaugcccauuuga

SEQ ID NO: 208236 - RNA, 1410 nt, Artificial Sequence
  derived and/or modified sequence opt5 from neuraminidase__InfluenzaA__AHN96453
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuugacaaugugcauagcaacaauaccguucggaaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagauuaaucggcaggucaucguggaccgcggcgauagaagcggcuacucugggauuuucuccaucgaaggaaaaagcuguauuaaccggugcuuuuaugucgagcugaucagaggccgcaaggaagagaccgaagugcuguggacauccaauucuauuguuguguucugugggaccagcggaacauacggcacgggguccuggccugacggcgcugaucucaaccugaugcccaucuga

SEQ ID NO: 208237 - RNA, 1410 nt, Artificial Sequence
  derived and/or modified sequence opt5 from neuraminidase__InfluenzaA__AHZ13526
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacaugacagaaauuguguaucugaccaauacaaccaucgagaaggaaauuugucccaaacucgucgaguaccggaacugguccaagccucagugcaaaaucacgggguucgcccccuuuucuaaggacaauagcauucgccuguccgcgggaggcgauaucugggugaccagagagccuuauguuucuugugacccggggaagugcuaccaauucgcucuuggacagggcacaacccugaacaauaaacauagcaacgauacaauccacgaccggacccccuaucgcacgcuccugaugaaugaacugggggugccuuuucaucucggaacaaagcaggucuguauugccugguccuccucuuccugccacgauggcaaagccuggcugcauguguguguuaccggccacgacaagaacgcuacagccagcuucaucuacgaugggagacuuguggacucuauuggauccuggagcaaaaauauccugcggacccaggagucugaaugcgucuguauuaacgggaccugcacaguggugaugacggauggcuccgcuagcgaccgcgccgauaccaagauccucuuuaucgaggagggaaagauuguccacaucagcccccugucuggcagcgcgcaacauguugaagagugcuccuguuauccuagauaccccggggugcggugcgugugucgcgacaauuggaaaggaagcaacagaccgauugucgauaucaacgugaaggacuacucuauuguuuccagcuaugugugcucuggccuugucggcgacacaccucggaaaaaugaugggagcuccucuagcuacugucgcaaccccaauaacgaaaagggaaaucacggcgugaaagggugggccuucgacgauggaaacgacguuuggaugggcagaaccaucggggaggaacugcgguccggauaugagacauuuaaggugaucggcggcuggagcaccccuaauucuaaacuccagauuaaccgccaggucaucguggauuccaauaacagaagcggguacucuggaauuuucuccgucgagggcaagagcugcaucaaucgguguuuuuauguggaacugauuagagggcgcgagcaggaaacgcggguuugguggacauccaacucuaucguggucuucugcggaaccagcggcaccuacgggacaggcuccuggcccgacggagcugauauuaaucugaugcccaucuga

SEQ ID NO: 208238 - RNA, 1413 nt, Artificial Sequence; identical to SEQ ID NO: 203229
  derived and/or modified sequence opt5 from neuraminidase__InfluenzaA__AHZ13584

SEQ ID NO: 208239 - RNA, 1410 nt, Artificial Sequence; identical to SEQ ID NO: 205946
  derived and/or modified sequence opt5 from neuraminidase__InfluenzaA__AHZ35575

SEQ ID NO: 208240 - RNA, 1410 nt, Artificial Sequence; identical to SEQ ID NO: 205946
  derived and/or modified sequence opt5 from neuraminidase__InfluenzaA__AHZ35587

SEQ ID NO: 208241 - RNA, 1410 nt, Artificial Sequence
  derived and/or modified sequence opt5 from neuraminidase__InfluenzaA__AHZ35611
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggcggagcuguaucaacagaugcuuuuauguggaacugauucgcggacggaaagaggaaaccgagguucuguggacauccaauucuaucguggucuucuguggcaccagcgggacauacggaacgggcuccuggccugacggggcugaucucaaccugaugcccauuuga

SEQ ID NO: 208242 - RNA, 1410 nt, Artificial Sequence; identical to SEQ ID NO: 205946
  derived and/or modified sequence opt5 from neuraminidase__InfluenzaA__AHZ35623

SEQ ID NO: 208243 - RNA, 1410 nt, Artificial Sequence; identical to SEQ ID NO: 205946
  derived and/or modified sequence opt5 from neuraminidase__InfluenzaA__AHZ35635

SEQ ID NO: 208244 - RNA, 1410 nt, Artificial Sequence
  derived and/or modified sequence opt5 from neuraminidase__InfluenzaA__AHZ35647
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccugacgugcggugugucugccgcgauaacuggaagggcagcaauagacccaucguggacauuaacaucaaagaccacucuauuguuuccagcuacguguguucugggcuggucggagauaccccgcggaagaaugacagcuccucuagcucccauugccuugauccuaacaaugaggaaggcggccacggggugaaaggaugggccuucgacgauggcaacgacguuuggauggggcgcacgaucaaugagacaagcagacugggauaugagaccuuuaaggugaucgaaggcuggucuaaccccaaauccaagcuccagauuaaucggcaggucaucguggaucgcggggacagaagcggauacucuggcauuuucuccgucgagggcaaaagcuguaucaaccggugcuuuuauguggaacugauuagagggcgcaaggaggaaaccgagguucuguggacauccaauucuaucguggucuucuguggaaccagcggcacauacgggacgggauccuggccugauggcgcugaccucaaccugaugcccauuuga

SEQ ID NO: 208245 - RNA, 1410 nt, Artificial Sequence; identical to SEQ ID NO: 205946
  derived and/or modified sequence opt5 from neuraminidase__InfluenzaA__AHZ35659

SEQ ID NO: 208246 - RNA, 1410 nt, Artificial Sequence; identical to SEQ ID NO: 205946
  derived and/or modified sequence opt5 from neuraminidase__InfluenzaA__AHZ35671

SEQ ID NO: 208247 - RNA, 1410 nt, Artificial Sequence; identical to SEQ ID NO: 205946
  derived and/or modified sequence opt5 from neuraminidase__InfluenzaA__AHZ35683

SEQ ID NO: 208248 - RNA, 1410 nt, Artificial Sequence
  derived and/or modified sequence opt5 from neuraminidase__InfluenzaA__AHZ35695
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaaccugcugaguaccggaauuggagcaagccccagugugacauuaccggguucgccccuuuuuccaaagauaacucuauccgccucagcgcgggaggcgacaucugggugacaagagagccguaugucuccugcgaucccgacaaguguuaccaauucgcucuggggcagggaaccacacuuaauaacgugcauucuaauaacaccguucgggaucgcacgccuuauagaacacugcucaugaaugaacugggcgugcccuuucaccuggggaccaagcaggucugcauugccuggagcuccagcucuugucaugacggaaaagccuggcuccacgugugcaucacaggcgaugacaagaacgcuaccgccuccuucauuuacaaugagcggcugguugauagcguggucucuugguccaaagaaauccuucgcacccaggagagcgagugugugugcauuaacggcacauguacgguggucaugaccgacgggucugcuuccggaaaggccgauacaaaaauccuguuuaucgaagagggcaagauuguucauaccagcacacucuccgggucugcgcaacacguggaagagugcagcugcuauccuagauaccccggagugcggugugucugccgcgacaacuggaagggcuccaauagaccgaucguggauauuaacaucaaagaccacagcauuguuucuuccuacguguguagcgggcuggucggagacaccccucggaagaaugauucuagcuccucuagccauugccuugaccccaacaaugaagagggcggccacggggugaaaggaugggccuucgaugacggcaacgauguuuggauggggcgcacgaucaaugagacauccagacugggauaugaaaccuuuaaggugaucgagggcuggagcaacccuaaaucuaagcuccagauuaaucggcaggucaucguggaccgcggggauagauccggauacagcggcauuuucucugucgaaggcaacuccuguaucaaucggugcuuuuauguggagcugauuagagggcgcaaagaagagaccgagguucuguggacaagcaacuccaucguggucuucuguggaaccucuggcacauacgggacgggaagcuggcccgacggcgcugaucucaaucugaugcccauuuga

SEQ ID NO: 208249 - RNA, 1410 nt, Artificial Sequence
  derived and/or modified sequence opt5 from neuraminidase__InfluenzaA__AHZ35719
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggacauccaauucuaucguggucuucuguggcaccagcgggacauacggaacgggcuccuggccugacggggcugaucucaaccugacccccauuuga

SEQ ID NO: 208250 - RNA, 1410 nt, Artificial Sequence; identical to SEQ ID NO: 205946
  derived and/or modified sequence opt5 from neuraminidase__InfluenzaA__AHZ35731

SEQ ID NO: 208251 - RNA, 1410 nt, Artificial Sequence; identical to SEQ ID NO: 205946
  derived and/or modified sequence opt5 from neuraminidase__InfluenzaA__AHZ35743

SEQ ID NO: 208252 - RNA, 1410 nt, Artificial Sequence; identical to SEQ ID NO: 205946
  derived and/or modified sequence opt5 from neuraminidase__InfluenzaA__AHZ35755

SEQ ID NO: 208253 - RNA, 1410 nt, Artificial Sequence; identical to SEQ ID NO: 205946
  derived and/or modified sequence opt5 from neuraminidase__InfluenzaA__AHZ35767

SEQ ID NO: 208254 - RNA, 1410 nt, Artificial Sequence; identical to SEQ ID NO: 205946
  derived and/or modified sequence opt5 from neuraminidase__InfluenzaA__AHZ35779

SEQ ID NO: 208255 - RNA, 1410 nt, Artificial Sequence
  derived and/or modified sequence opt5 from neuraminidase__InfluenzaA__AHZ35803
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccuggaaugccgcaccuuuuuccucacacagggcgcccugcuuaaugacaaacauuccaacggcaccauuaaggauagaagcccuuaucggacgcugaugucuugucccaucggggaggugccuucccccuacaacagccgcuuugaauccguugccuggucugcuagcgccugccacgacggaauuaauuggcucaccaucggcaucuccgggccugauaacggagcuguggccguccugaaguauaauggcauuaucacagacaccauuaaaagcuggagaaacaauauccugcggacacaggagucugagugugcgugcgugaacggguccuguuucaccauuaugacggauggaccgagcgacggccaagccucuuacaagaucuuucgcaucgaaaaaggcaagauugugaaaagcgucgagaugaaugcucccaacuaucauuacgaagagugcuccuguuacccugauucuagcgagaucacaugcguuugcagagacaauuggcacggguccaaccggcccugggugagcuucaaucagaaccucgaauaucagauuggauacaucuguucuggcauuuuuggggauaauccucgcccccaugacaagaccggauccugcggcccggugagcucuaacggggccaauggagucaagggcuucuccuuuaaauauggcaacgggguguggaucggaagaacaaagagcauuuccucucggaaaggcuucgagaugaucugggauccuaacggguggaccggaaccgacaauaacuuuagcaucaagcaggacauuguuggcaugaaugaaugguccggguacucuggcagcuucgugcaacaccccgagcugacaggacuugauuguauccgcccuugcuucugggucgaacugauuagaggccggcccaaagagaacacgaucuggaccuccgggagcucuauuuccuuuuguggagugaauagcgacacaguuggcuggucuuggcccgauggggcugagcucccuuucaccaucgacaaguga

SEQ ID NO: 208256 - RNA, 1410 nt, Artificial Sequence
  derived and/or modified sequence opt5 from neuraminidase__InfluenzaA__AHZ35814
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgaccuuugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcaucgccugguccucuagcuccugucaugacggaaaagccuggcuucacgugugcauuacaggcgaugacaagaacgcuaccgccagcuucaucuacaauggccggcugguugauucuguggucuccuggagcaaagagauucuccgcacccaggaaucugagugugugugcaucaacgggacauguacgguggucaugaccgacggauccgcuagcggcaaggccgauacaaaaauucuguuuaucgaggaagggaagaucguucauaccuccacacuuucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuggucggcgacacgccccggaagaaugauagcuccucuagcucccauugccucgacccgaacaaugaggaaggcgggcacggagugaaaggcugggccuucgaugacgggaacgauguuuggaugggacgcaccauuaaugagacaagcagacugggcuaugagaccuuuaaggugaucgaaggguggucuaacccuaaauccaagcugcagaucaaucggcaggucauuguggaccgcggaaacagaagcggcuacucuggcaucuucuccgucgaggggaaaagcuguauuaaucggugcuuuuauguggaacucaucagaggacgcaaggaggaaaccgagguucuguggacauccaacucuauuguggucuucuguggcaccagcgggacauacggaacgggcuccuggcccgauggggcugaccuuaaucugaugccuaucuga

SEQ ID NO: 208257 - RNA, 1410 nt, Artificial Sequence
  derived and/or modified sequence opt5 from neuraminidase__InfluenzaA__AHZ35837
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccuggaaugccgcaccuuuuuccucacacagggcgcccugcuuaaugacaaacauuccaacggcaccauuaaggauagaagcccuuaucggacgcugaugucuugucccaucggggaggugccuucccccuacaacagccgcuuugaauccguugccuggucugcuagcgccugccacgacggaauuaauuggcucaccaucggcaucuccgggccugauaacggagcuguggccguccugaaguauaauggcauuaucacagacaccauuaaaagcuggagaaacaauauccugcggacacaggagucugagugugcgugcgugaacggguccuguuucaccauuaugacggauggaccgagcgacggccaagccucuuacaagaucuuucgcaucgaaaaaggcaagauugugaaaagcgucgagaugaaugcucccaacuaucauuacgaagagugcuccuguuacccugauucuagcgagaucacaugcguuugcagagacaauuggcacggguccaaccggcccugggugagcuucaaucagaaccucgaauaucagauuggauacaucuguucuggcauuuuuggggauaauccucgcccccaugacaagaccggauccugcggcccggugagcucuaacggggccaauggagucaagggcuucuccuuuaaauauggcaacgggguguggaucggaagaacaaagagcauuuccucucggaaaggcuucgagaugaucugggauccuaacggguggaccggaaccgacaauaacuuuagcaucaagcaggacauuguuggcaucaaugaaugguccggguacucuggcagcuucgugcaacaccccgagcugacaggacuugauuguauucgcccuugcuucugggucgaacugaucagaggccggcccaaagagaacacgauuuggaccuccgggagcucuaucuccuuuuguggagugaauagcgacacaguuggcuggucuuggcccgauggggcugagcucccuuucaccaucgacaaguga

SEQ ID NO: 208258 - RNA, 1410 nt, Artificial Sequence; identical to SEQ ID NO: 208257
  derived and/or modified sequence opt5 from neuraminidase__InfluenzaA__AHZ35848

SEQ ID NO: 208259 - RNA, 1410 nt, Artificial Sequence; identical to SEQ ID NO: 208257
  derived and/or modified sequence opt5 from neuraminidase__InfluenzaA__AHZ35859

SEQ ID NO: 208260 - RNA, 1410 nt, Artificial Sequence; identical to SEQ ID NO: 208256
  derived and/or modified sequence opt5 from neuraminidase__InfluenzaA__AHZ35870

SEQ ID NO: 208261 - RNA, 1410 nt, Artificial Sequence; identical to SEQ ID NO: 208256
  derived and/or modified sequence opt5 from neuraminidase__InfluenzaA__AHZ35882

SEQ ID NO: 208262 - RNA, 1410 nt, Artificial Sequence
  derived and/or modified sequence opt5 from neuraminidase__InfluenzaA__AHZ35894
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccuggaaugccgcaccuuuuuccucacacagggcgcccugcuuaaugacaaacauuccaacggcaccauuaaggauagaagcccuuaucggacgcugaugucuugucccaucggggaggugccuucccccuacaacagccgcuuugaauccguugccuggucugcuagcgccugccacgacggaauuaauuggcucaccaucggcaucuccgggccugauaacggagcuguggccguccugaaguauaauggcauuaucacagacaccauuaaaagcuggagaaacaauauccugcggacacaggagucugagugugcgugcgugaacggguccuguuucaccauuaugacggauggaccgagcgacggccaagccucuuacaagaucuuucgcaucgaaaaaggcaagauugugaaaagcgucgagaugaaugcucccaacuaucauuacgaagagugcuccuguuacccugauucuagcgagaucacaugcguuugcagagacaauuggcacggguccaaccggcccugggugagcuucaaucagaaccucgaauaucagauuggauacaucuguucuggcauuuuuggggauaauccucgcccccaugacaagaccggauccugcggcccggugagcucuaacggggccaauggagucaagggcuucuccuuuaaauauggcagcgggguguggaucggaagaacaaaguccauuucuagccggaaaggcuucgagaugaucugggauccuaacggguggaccggaaccgacaacaauuuuuccaucaagcaggacauuguuggcaucaacgaauggucuggguacagcggcuccuucgugcaacaccccgagcugacaggacuugauuguauucgcccuugcuucugggucgaacugaucagaggccggcccaaagagaauacgauuuggaccagcgggucuuccaucagcuuuuguggagugaacucugacacaguuggcugguccuggcccgauggggcugagcucccuuucaccaucgacaaguga

SEQ ID NO: 208263 - RNA, 1410 nt, Artificial Sequence; identical to SEQ ID NO: 208257
  derived and/or modified sequence opt5 from neuraminidase__InfluenzaA__AHZ35905

SEQ ID NO: 208264 - RNA, 1410 nt, Artificial Sequence; identical to SEQ ID NO: 208257
  derived and/or modified sequence opt5 from neuraminidase__InfluenzaA__AHZ35916

SEQ ID NO: 208265 - RNA, 1410 nt, Artificial Sequence; identical to SEQ ID NO: 203982
  derived and/or modified sequence opt5 from neuraminidase__InfluenzaA__AHZ35927

SEQ ID NO: 208266 - RNA, 1410 nt, Artificial Sequence
  derived and/or modified sequence opt5 from neuraminidase__InfluenzaA__AHZ35938
augaaccccaaucagaagaucauuaccaucggcagcgugugcaugauuaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacaaucaugaccgauggaccgagcgacggccaggccucuuacaaaaucuuucgcauugaaaagggcaaaaucgucaagagcguggagaugaaugcucccaacuaucauuacgaagagugcuccuguuacccugauucuagcgagauuacgugcguuugcagagacaauuggcacggguccaaccggcccugggugagcuucaaucagaaccuggaauaucagaucggauacauuuguucuggcaucuuuggggauaauccucgcccccaugacaaaacaggauccugcggcccggugagcucuaacggggccaauggagucaagggcuucuccuuuaaguauggcaacgggguguggauuggaagaaccaaaagcaucuccucucggaagggcuucgagaugaucugggauccuaacggguggacaggaaccgacaauaacuuuagcauuaaacaagacaucguuggcauuaaugaaugguccggguacucuggcagcuucgugcagcaccccgagcuuaccggacuggauuguauccgcccuugcuucugggucgaacucauuagaggccggcccaaggagaacacaaucuggacguccgggagcucuaucuccuuuuguggagugaauagcgacaccguuggcuggucuuggcccgauggggcugagcugccuuucacaauugacaaauga

SEQ ID NO: 208267 - RNA, 1410 nt, Artificial Sequence; identical to SEQ ID NO: 208256
  derived and/or modified sequence opt5 from neuraminidase__InfluenzaA__AHZ35949

SEQ ID NO: 208268 - RNA, 1410 nt, Artificial Sequence
  derived and/or modified sequence opt5 from neuraminidase__InfluenzaA__AHZ35961
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccuggaaugccgcaccuuuuuccucacacagggcgcccugcuuaaugacaaacauuccaacggcaccauuaaggauagaagcccuuaucggacgcugaugucuugucccaucggggaggugccuucccccuacaacagccgcuuugaauccguugccuggucugcuagcgccugccacgacggaauuaauuggcucaccaucggcaucuccgggccugauaacggagcuguggccguccugaaguauaauggcauuaucacagacaccauuaaaagcuggagaaacaauauccugcggacacaggagucugagugugcgugcgugaacggguccuguuucaccauuaugacggauggaccgagcgacggccaagccucuuacaagaucuuucgcaucgaaaaaggcaagauugugaaaagcgucgagaugaaugcucccaacuaucauuacgaagagugcuccuguuacccugauucuagcgagaucacaugcguuugcagagacaauuggcacggguccaaccggcccugggugagcuucaaucagaaccucgaauaucagauuggauacaucuguucuggcauuuuuggggauaauccucgcccccaugacaagaccggauccugcggcccggugagcucuaacggggccaauggagucaagggcuucuccuuuaaauauggcaacgggguguggaucggaagaacaaagagcauuuccucucggaaaggcuucgagaugaucugggauccuaacggguggaccggaaccgacaauaacuuuagcaucaagcaggacauuguuggcaucaaugaaugguccggguacucuggcagcuucgugcaacaccccgagcugacaggacuugauuguauucgcccuugcuucugggucgaacugaucagaggccggcccaaagaguccacgauuuggaccagcgggucuuccaucagcuuuuguggagugaacucugacacaguuggcugguccuggcccgauggggcugagcucccuuucaccaucgacaaguga

SEQ ID NO: 208269 - RNA, 1410 nt, Artificial Sequence; identical to SEQ ID NO: 208257
  derived and/or modified sequence opt5 from neuraminidase__InfluenzaA__AHZ35972

SEQ ID NO: 208270 - RNA, 1410 nt, Artificial Sequence
  derived and/or modified sequence opt5 from neuraminidase__InfluenzaA__AHZ35983
augaaccccaaucagaagaucaccacaauuggcagcgugugcaugacgaucgggauggccaaccugaugcuccaaauuggaaauaucauuuccaucuggaucucucacagcauucagcugggcaacaaaaaucagaucgagaccuguaaccaguccgucauuacauacgaaaauaacaccuggguuaaucaaacauaugugaacaucucuaauaccaacuucgcugccgggcagagcguggucuccgugaagauugcgggaaauucuagccuuugcccuguuuccggcugggcuaucuacagcaaagacaacucuauuagaaucggguccaagggagauguguuugucauccgggagccguucauuagcuguucuccccuggaaugccgcacauuuuuccucacccagggcgcccugcuuaaugacaaacauuccaacggcacgaucaaggauagaagcccuuaucggacccugaugucuugucccauuggggaggugccuucccccuacaacagccgcuuugaauccguugccuggucugcuagcgccugccacgacggaaucaauuggcucacaauuggcaucuccgggccugauaacggagcuguggccguccugaaguauaauggcaucauuaccgacacaaucaaaagcuggagaaacaauauucugcggacccaggagucugagugugcgugcgugaacggguccuguuucacgaucaugacagauggaccgagcgacggccaagccucuuacaagauuuuucgcaucgaaaaaggcaagaucgugaaaagcgucgagaugaaugcucccaacuaucauuacgaagagugcuccuguuacccugauucuagcgagauuaccugcguuugcagagacaauuggcacggguccaaccggcccugggugagcuucaaucagaaccucgaauaucagaucggauacauuuguucuggcaucuuuggggauaauccucgcccccaugacaagacaggauccugcggcccggugagcucuaacggggccaauggagucaagggcuucuccuuuaaauauggcaacgggguguggauuggaagaaccaagagcaucuccucucggaaaggcuucgagaugauuugggauccuaacggguggaccggaacagacaauaacuuuagcaucaagcaggacaucguuggcauuaaugaaugguccggguacucuggcagcuucgugcaacaccccgagcugacgggacuugauuguauccgcccuugcuucugggucgaacugauuagaggccggcccaaagagaacaccaucuggacauccgggagcucuauuuccuuuuguggagugaauagcgacaccguuggcuggucuuggcccgauggggcugagcucccuuucacaaucgacaaguga

SEQ ID NO: 208271 - RNA, 1410 nt, Artificial Sequence; identical to SEQ ID NO: 208257
  derived and/or modified sequence opt5 from neuraminidase__InfluenzaA__AHZ35994

SEQ ID NO: 208272 - RNA, 1410 nt, Artificial Sequence; identical to SEQ ID NO: 208257
  derived and/or modified sequence opt5 from neuraminidase__InfluenzaA__AHZ36005

SEQ ID NO: 208273 - RNA, 1410 nt, Artificial Sequence; identical to SEQ ID NO: 208257
  derived and/or modified sequence opt5 from neuraminidase__InfluenzaA__AHZ36016

SEQ ID NO: 208274 - RNA, 1410 nt, Artificial Sequence
  derived and/or modified sequence opt5 from neuraminidase__InfluenzaA__AHZ36027
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaucuacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggauucaauuggcugacgaucggcaucuccgggccugauaacggagcuguggccguccugaaguauaauggcauuaucaccgacacaauuaagagcuggagaaacaauauccuccggacccaagagucugagugugcgugcgugaacggguccuguuuuacaauuaugaccgauggaccgagcgacggccaggccucuuacaaaaucuuccgcaucgaaaagggcaaaauugucaagagcguggagaugaaugcucccaacuaucauuacgaagagugcuccuguuacccugauucuagcgagaucacgugcguuugcagagacaauuggcacggguccaaccggcccugggugagcuuuaaucagaaccuggaauaucagauuggauacaucuguucuggcauuuucggggauaauccucgccccaacgacaaaacaggauccugcggcccggugagcucuaauggggccaacggagucaagggcuuuuccuucaaguauggcaacgggguguggaucggaagaaccaaaagcauuuccucucggaagggcuuugagaugaucugggauccuaauggguggacaggaaccgacaacaauuucagcaucaaacaagacauuaucggcauuaacgaaugguccggguacucuggcagcuucguucagcaucccgagcuuaccggacuggauuguauccgcccuugcuuuuggguggaacucauuagaggccggcccaaggagaauacaaucuggacguccgggagcucuaucuccuucuguggagucaacagcgacaccgugggcuggucuuggcccgauggggcugagcugccuuuuacaauugacaaauga

SEQ ID NO: 208275 - RNA, 1410 nt, Artificial Sequence
  derived and/or modified sequence opt5 from neuraminidase__InfluenzaA__AHZ36050
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggcgcaaugauagcuccucuagcucccauugccuggacccgaacaaugaggaaggcgggcacggagugaagggcugggccuucgaugacgggaacgauguuuggaugggaagaaccaucaaugagacaagccggcucggcuaugagaccuuuaaagugaucgaaggguggucuaacccuaaguccaaacugcagauuaaucgccaggucaucguggacagaggaaaccggagcggcuacucuggcauuuucuccgucgaggggaagucuuguaucaauagaugcuuuuauguggaacugauucgcggacggaaagaggaaaccgagguucucuggacauccaacucuaucguggucuucuguggcaccagcgggacauacggaacgggcuccuggcccgauggggcugaccugaaucuuaugccuauuuga

SEQ ID NO: 208276 - RNA, 1410 nt, Artificial Sequence
  derived and/or modified sequence opt5 from neuraminidase__InfluenzaA__AHZ36062
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccugggcugccgcaccuuuuuccucacacagggcgcccugcuuaaugacaaacauuccaacgggaccauuaaggauagaagcccuuaucggacgcugaugucuugucccaucggagaagugccuucccccuacaacagccgcuuugaguccguugccuggucugcuagcgccugccacgacggcauuaauuggcucaccaucgggaucuccggaccugauaacggcgcuguggccguccugaaguauaaugggauuaucacagacaccauuaaaagcuggagaaacaauauccugcggacacaggaaucugagugugcgugcgugaacggauccuguuucaccauuaugacggauggcccgagcgacggccaagccucuuacaagaucuuucgcaucgagaaagggaagauugugaaaagcgucgaaaugaaugcucccaacuaucauuacgaggaaugcuccuguuacccugauucuagcgagaucacaugcguuugcagagacaauuggcacggauccaaccggcccugggugagcuucaaucagaaccucgaguaucagauuggcuacaucuguucugggauuuuuggagauaauccucgcccccaugacaagaccggcuccugcgggccggugagcucuaacggagccaauggcgucaagggcuucuccuuuaaauaugggaacggaguguggaucggcagaacaaagagcauuuccucucggaaaggguucgaaaugaucugggauccuaacggauggaccggcaccgacaauaacuuuagcaucaagcaggacauuguugggaucaaugagugguccggcuacucuggcagcuucgugcaacaccccgaacugacaggacuugauuguauucgcccuugcuucugggucgagcugaucagagggcggcccaaagaaaacacgauuuggaccuccggaagcucuaucuccuuuuguggcgugaauagcgacacaguuggguggucuuggcccgauggagcugagcucccuuucaccaucgacaaguga

SEQ ID NO: 208277 - RNA, 1410 nt, Artificial Sequence; identical to SEQ ID NO: 208257
  derived and/or modified sequence opt5 from neuraminidase__InfluenzaA__AHZ36084

SEQ ID NO: 208278 - RNA, 1410 nt, Artificial Sequence
  derived and/or modified sequence opt5 from neuraminidase__InfluenzaA__AHZ36095
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaucuacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggauucaauuggcugacgaucggcaucuccgggccugauaacggagcuguggccguccugaaguauaauggcauuaucaccgacacaauuaagagcuggagaaacaauauccuccggacccaagagucugagugugcgugcgugaacggguccuguuuuacaauuaugaccgauggaccgagcgacggccaggccucuuacaaaaucuuccgcaucgaaaagggcaaaauugucaagagcguggagaugaaugcucccaacuaucauuacgaagagugcuccuguuacccugauucuagcgagaucacgugcguuugcagagacaauuggcacggguccaaccggcccugggugagcuuuaaucagaaccuggaauaucagauuggauacaucuguucuggcauuuucggggauaauccucgccccaacgacaaaacaggaggcugcgggccgguguccagcaauggagccaacggcgucaagggcuuuucuuucaaguaugggaacggaguguggaucggcagaaccaaauccauuagcucccggaagggguuugagaugaucugggauccuaauggauggacaggcaccgacaacaauuucucuaucaaacaagacauuaucgggauuaacgaauggagcggcuacuccggaucuuucguucagcaucccgagcuuaccggccuggauuguauccgcccuugcuuuuggguggaacucauuagagggcggcccaaggagaauacaaucuggacgagcggauccagcaucucuuucuguggcgucaacuccgacaccgugggguggagcuggcccgauggagcugagcugccuuuuacaauugacaaauga

SEQ ID NO: 208279 - RNA, 1410 nt, Artificial Sequence; identical to SEQ ID NO: 208257
  derived and/or modified sequence opt5 from neuraminidase__InfluenzaA__AHZ36106

SEQ ID NO: 208280 - RNA, 1410 nt, Artificial Sequence
  derived and/or modified sequence opt5 from neuraminidase__InfluenzaA__AHZ36117
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaucuacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuuguuccauuggggaggugcccagcccuuacaacucccgcuuugaaucuguugccuggagcgcuuccgccugccacgacggauucaauuggcugacgaucggcaucagcgggcccgauaacggagcuguggccguccugaaguauaauggcauuaucaccgacacaauuaagucuuggagaaacaauauccuccggacccaagaguccgagugugcgugcgugaacgggagcuguuuuacaauuaugaccgauggaccuucugacggccaggccagcuacaaaaucuuccgcaucgaaaagggcaaaauugugaaguccgucgagaugaaugcuccgaacuaucauuacgaagagugcucuuguuaccccgauagcuccgagaucacgugcguuugcagagacaauuggcacgggagcaaccggccuugggugucuuuuaaucagaaccuggaauaucagauuggauacaucuguuccggcauuuucggggauaauccccgcccuaacgacaaaacaggaagcugcggccccgugucuuccaauggggccaacggagucaagggcuuuagcuucaaguauggcaacgggguguggaucggaagaaccaaauccauuucuagccggaagggcuuugagaugaucugggauccgaauggguggacaggaaccgacaacaauuucuccaucaaacaagacauuaucggcauuaacgaauggucuggguacagcggcuccuucguucagcauccugagcuuaccggacuggauuguauccgccccugcuuuuggguggaacucauuagaggccggccuaaggagaauacaaucuggacgagcgggucuuccaucagcuucuguggagucaacucugacaccgugggcugguccuggcccgauggggcugagcugcccuuuacaauugacaaauga

SEQ ID NO: 208281 - RNA, 1410 nt, Artificial Sequence; identical to SEQ ID NO: 208257
  derived and/or modified sequence opt5 from neuraminidase__InfluenzaA__AHZ36128

SEQ ID NO: 208282 - RNA, 1410 nt, Artificial Sequence; identical to SEQ ID NO: 208257
  derived and/or modified sequence opt5 from neuraminidase__InfluenzaA__AHZ36139

SEQ ID NO: 208283 - RNA, 1410 nt, Artificial Sequence; identical to SEQ ID NO: 208275
  derived and/or modified sequence opt5 from neuraminidase__InfluenzaA__AHZ36150

SEQ ID NO: 208284 - RNA, 1410 nt, Artificial Sequence; identical to SEQ ID NO: 208257
  derived and/or modified sequence opt5 from neuraminidase__InfluenzaA__AHZ36161

SEQ ID NO: 208285 - RNA, 1410 nt, Artificial Sequence; identical to SEQ ID NO: 208257
  derived and/or modified sequence opt5 from neuraminidase__InfluenzaA__AHZ36172

SEQ ID NO: 208286 - RNA, 1410 nt, Artificial Sequence
  derived and/or modified sequence opt5 from neuraminidase__InfluenzaA__AHZ36183
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccuggaaugccgcaccuuuuuccucacacagggcgcccugcuuaaugacaaacauuccaacggcaccauuaaggauagaagcccuuaucggacgcugaugucuugucccaucggggaggugccuucccccuacaacagccgcuuugaauccguugccuggucugcuagcgccugccacgacggaauuaauuggcucaccaucggcaucuccgggccugauaacggagcuguggccguccugaaguauaauggcauuaucacagacaccauuaaaagcuggagaaacaauauccugcggacacaggagucugagugugcgugcgugaacggguccuguuucaccauuaugacggauggaccgagcgacggccaagccucuuacaagaucuuucgcaucgaaaaaggcaagauugugaaaagcgucgagaugaaugcucccaacuaucauuacgaagagugcuccuguuacccugauucuagcgagaucacaugcguuugcagagacaauuggcacggguccaaccggcccugggugagcuucaaucagaaccucgaauaucagauuggauacaucuguucuggcauucugggggauaauccucgcccccaugacaagaccggauccugcggcccggugagcucuaacggggccaauggagucaagggcuuuuccuucaaauauggcaacgggguguggaucggaagaacaaagagcauuuccucucggaaaggcuuugagaugaucugggauccuaacggguggaccggaaccgacaauaacuucagcaucaagcaggacauuguuggcaucaaugaaugguccggguacucuggcagcuuugugcaacaccccgagcuuacaggacuggauuguauucgcccuugcuucugggucgaacucaucagaggccggcccaaagagaacacgauuuggaccuccgggagcucuaucuccuucuguggagugaauagcgacacaguuggcuggucuuggcccgauggggcugagcugccuuuuaccaucgacaaguga

SEQ ID NO: 208287 - RNA, 1410 nt, Artificial Sequence; identical to SEQ ID NO: 208256
  derived and/or modified sequence opt5 from neuraminidase__InfluenzaA__AHZ36194

SEQ ID NO: 208288 - RNA, 1410 nt, Artificial Sequence; identical to SEQ ID NO: 208275
  derived and/or modified sequence opt5 from neuraminidase__InfluenzaA__AHZ36206

SEQ ID NO: 208289 - RNA, 1410 nt, Artificial Sequence; identical to SEQ ID NO: 208257
  derived and/or modified sequence opt5 from neuraminidase__InfluenzaA__AHZ36218

SEQ ID NO: 208290 - RNA, 1410 nt, Artificial Sequence; identical to SEQ ID NO: 208275
  derived and/or modified sequence opt5 from neuraminidase__InfluenzaA__AHZ36229

SEQ ID NO: 208291 - RNA, 1410 nt, Artificial Sequence; identical to SEQ ID NO: 208257
  derived and/or modified sequence opt5 from neuraminidase__InfluenzaA__AHZ36241

SEQ ID NO: 208292 - RNA, 1410 nt, Artificial Sequence; identical to SEQ ID NO: 208257
  derived and/or modified sequence opt5 from neuraminidase__InfluenzaA__AHZ36252

SEQ ID NO: 208293 - RNA, 1410 nt, Artificial Sequence; identical to SEQ ID NO: 208257
  derived and/or modified sequence opt5 from neuraminidase__InfluenzaA__AHZ36263

SEQ ID NO: 208294 - RNA, 1410 nt, Artificial Sequence; identical to SEQ ID NO: 205946
  derived and/or modified sequence opt5 from neuraminidase__InfluenzaA__AHZ36274

SEQ ID NO: 208295 - RNA, 1410 nt, Artificial Sequence; identical to SEQ ID NO: 208257
  derived and/or modified sequence opt5 from neuraminidase__InfluenzaA__AHZ36286

SEQ ID NO: 208296 - RNA, 1410 nt, Artificial Sequence
  derived and/or modified sequence opt5 from neuraminidase__InfluenzaA__AHZ36297
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccucggcccgcugaguaccgcaauugguccaaaccucagugugacauuaccggguucgcccccuuuucuaaggauaacagcaucagacucuccgcgggaggcgacaucugggugacacgggagccuuaugucucuugcgauccggacaaauguuaccaauucgcucuggggcagggaaccacacuuaauaacgugcauagcaauaacaccguucgcgauagaacgcccuaucggacacugcucaugaaugaacugggcgugccuuuucaccuggggaccaagcaggucugcauugccugguccucuagcuccugucaugacggaaaggccuggcuccacgugugcaucacaggcgaugacaaaaacgcuaccgccagcuucauuuacaauggccgccugguugauucuguggucuccuggagcaaggagauccuuagaacccaggaaucugagugugugugcauuaacgggacauguacgguggucaugaccgacggauccgcuagcggcaaagccgauacaaagauccuguuuaucgaggaagggaaaauuguucauaccuccacacucucuggaggcgcgcaacacguggaggaaugcagcugcuauccccgguacccuggggugcgcugugucugcagagacaacuggaagggauccaaucggcccaucguggauauuaacaucaaggaccacagcauuguuucuuccuacguguguagcggccuggucggcgacaccccgcgcaaaaaugauucuagcuccucuagccauugccuugacccuaacaaugaggaagggggacacggcgugaaggggugggccuucgaugacggaaacgauguuuggaugggcagaacgaucaaugagacaucccggcugggguaugagaccuuuaaagugaucgaaggauggagcaaccccaagucuaaacuccagauuaaucgccaggucaucguggacagaggcgaucgguccggcuacagcgggauuuucucugucgagggaaaguccuguaucaacagaugcuuuuauguggaacugauucgcggccggaaagaggaaaccgagguucuguggacaagcaauuccaucguggucuucugugggaccucuggaacauacggcacggggagcuggccugacggcgcugaucucaaccugaugcccauuuga

SEQ ID NO: 208297 - RNA, 1410 nt, Artificial Sequence
  derived and/or modified sequence opt5 from neuraminidase__InfluenzaA__AHZ36309
augaaccccaaucagaagaucauuaccaucggcagcgugugcaugacaauugggauggccaaccugaugcuccaaaucggaaauauuaucuccaucuggauuucucacagcauccagcugggcgacaaaaaccagauugagacguguaaucaguccgucaucaccuacgaaaacaauacauggguuaaccaaaccuaugugaauauuucuaacacaaauuucgcugccgggcagagcguggucuccgugaagaucgcgggaaacucuagccuuugcccuguuuccggcugggcuauuuacagcaaagauaauucuaucagaaucggguccaagggagacguguuugucauucgggagccguucaucagcuguucuccccuggaaugccgcaccuuuuuccucacacagggcgcccugcuuaacgauaaacauuccaauggcaccauuaaggacagaagcccuuaucggacgcugaugucuugucccaucggggaggugccuucccccuacaacagccgcuuugaauccguugccuggucugcuagcgccugccacgauggaauuaacuggcucaccaucggcaucuccgggccugacaauggagcuguggccguccugaaguauaacggcauuaucacagauaccauuaaaagcuggagaaauaacauccugcggacacaggagucugagugugcgugcgugaauggguccuguuucaccauuaugacggacggaccgagcgauggccaagccucuuacaagaucuuucgcaucgaaaaaggcaagauugugaaaagcgucgagaugaacgcucccaauuaucauuacgaagagugcuccuguuacccugacucuagcgagaucacaugcguuugcagagauaacuggcacggguccaaucggcccugggugagcuucaaccagaaucucgaauaucagauuggauacaucuguucuggcauuuuuggggacaacccucgcccccaugauaagaccggauccugcggcccggugagcucuaauggggccaacggagucaagggcuucuccuuuaaauauggcaaugggguguggaucggaagaacaaagagcauuuccucucggaaaggcuucgagaugaucugggacccuaacggguggaccggaaccgacaacaauuuuagcaucaagcaggauauuguuggcaucaacgaaugguccggguacucuggcagcuucgugcaacaccccgagcugacaggacuugacuguauucgcccuugcuucugggucgaacugaucagaggccggcccaaagagaauacgauuuggaccuccgggagcucuaucuccuuuuguggagugaacagcgauacaguuggcuggucuuggcccgacggggcugagcucccuuucaccaucgauaaguga

SEQ ID NO: 208298 - RNA, 1410 nt, Artificial Sequence; identical to SEQ ID NO: 208257
  derived and/or modified sequence opt5 from neuraminidase__InfluenzaA__AHZ36320

SEQ ID NO: 208299 - RNA, 1410 nt, Artificial Sequence; identical to SEQ ID NO: 208257
  derived and/or modified sequence opt5 from neuraminidase__InfluenzaA__AHZ36331

SEQ ID NO: 208300 - RNA, 1410 nt, Artificial Sequence; identical to SEQ ID NO: 205946
  derived and/or modified sequence opt5 from neuraminidase__InfluenzaA__AHZ36353

SEQ ID NO: 208301 - RNA, 1410 nt, Artificial Sequence
  derived and/or modified sequence opt5 from neuraminidase__InfluenzaA__AHZ36365
augaaccccaaucagaagaucauuaccaucggcagcgugugcaugacaauugggauggccaaccugaugcuccaaaucggaaauauuaucuccaucuggauuucucacccuauccagcugggcaacaaaaaucagauugagacguguaaccagagcgucaucaccuacgaaaauaacacauggguuaaucaaaccuaugugaacauuuccaauacaaacuucgcugccgggcagucuguggucagcgugaagaucgcgggaaauuccucucuuugcccgguuagcggcugggcuauuuacuccaaagacaacagcaucagaaucgggucuaagggagauguguuugucauucgggagcccuucaucuccuguagcccucuggaaugccgcaccuuuuuccucacacagggcgcccugcuuaaugacaaacauucuaacggcaccauuaaggauagaucccccuaucggacgcugaugagcuguccuaucggggaggugcccucuccuuacaacucccgcuuugaaagcguugccugguccgcuucugccugccacgacggaauuaauuggcucaccaucggcaucagcgggccggauaacggagcuguggccguccugaaguauaauggcauuaucacagacaccauuaaauccuggagaaacaauauccugcggacacaggagagcgagugugcgugcgugaacgggucuuguuucaccauuaugacggauggacccuccgacggccaagccagcuacaagaucuuucgcaucgaaaaaggcaagauugugaaaucugucgagaugaaugcuccuaacuaucauuacgaagagugcagcuguuaccccgauuccucugagaucacaugcguuugcagagacaauuggcacgggagcaaccggccuuggguguccuucaaucagaaccucgaauaucagauuggauacaucuguagcggcauuuuuggggauaauccccgcccgcaugacaagaccggaucuugcggcccuguguccagcaacggggccaauggagucaagggcuucucuuuuaaauauggcaacgggguguggaucggaagaacaaaguccauuagcucccggaaaggcuucgagaugaucugggaucccaacggguggaccggaaccgacaauaacuuuucuaucaagcaggacauuguuggcaucaaugaauggagcggguacuccggcucuuucgugcaacacccugagcugacaggacuugauuguauucgccccugcuucugggucgaacugaucagaggccggcccaaagagaacacgauuuggaccagcggguccagcaucucuuuuuguggaguuaauuccgacacagugggcuggagcuggccugauggggcugagcucccguucaccaucgacaaguga

SEQ ID NO: 208302 - RNA, 1410 nt, Artificial Sequence; identical to SEQ ID NO: 205946
  derived and/or modified sequence opt5 from neuraminidase__InfluenzaA__AHZ36376

SEQ ID NO: 208303 - RNA, 1410 nt, Artificial Sequence; identical to SEQ ID NO: 205946
  derived and/or modified sequence opt5 from neuraminidase__InfluenzaA__AHZ36388

SEQ ID NO: 208304 - RNA, 1410 nt, Artificial Sequence; identical to SEQ ID NO: 205946
  derived and/or modified sequence opt5 from neuraminidase__InfluenzaA__AHZ36400

SEQ ID NO: 208305 - RNA, 1410 nt, Artificial Sequence; identical to SEQ ID NO: 205946
  derived and/or modified sequence opt5 from neuraminidase__InfluenzaA__AHZ36412

SEQ ID NO: 208306 - RNA, 1410 nt, Artificial Sequence; identical to SEQ ID NO: 205946
  derived and/or modified sequence opt5 from neuraminidase__InfluenzaA__AHZ36424

SEQ ID NO: 208307 - RNA, 1410 nt, Artificial Sequence; identical to SEQ ID NO: 205946
  derived and/or modified sequence opt5 from neuraminidase__InfluenzaA__AHZ36436

SEQ ID NO: 208308 - RNA, 1410 nt, Artificial Sequence
  derived and/or modified sequence opt5 from neuraminidase__InfluenzaA__AHZ36448
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuaagcccgcugaguacagaaauugguccaaaccucagugugacauuaccggguucgcccccuuuucuaaggauaacagcauccggcucuccgcgggaggcgacaucugggugacacgcgagccuuaugucucuugcgauccggacaaguguuaccaauucgcucuggggcagggaaccacacuuaauaacgugcauagcaauaacaccguuagagaucggacgcccuaucgcacacugcucaugaaugaacugggcgugccuuuucaccuggggaccaaacaggucugcauugccugguccucuagcuccugucaugacggaaaggccuggcuccacgugugcaucacaggcgaugacaaaaacgcuaccgccagcuucauuuacaauggcagacugguugauucuguggucuccuggagcaaggagauccuucggacccaggaaucugagugugugugcauuaacgggacauguacgguggucaugaccgacggauccgcuagcggcaaagccgauacaaagauccuguuuaucgaggaagggaagauuguucauaccuccacacucucuggaagcgcgcaacacguggaggaaugcuccugcuauccccgcuacccuggcgugagaugugucugccgggacaacuggaaagggagcaaucgccccaucguggauauuaacaucaaggaccacucuauuguuuccagcuacguguguucuggacuggucggcgacaccccgagaaagaaugauagcuccucuagcucccauugccuugacccuaacaaugaggaaggcgggcacggagugaagggcugggccuucgaugacgggaacgauguuuggaugggacggacgaucaaugagacaagccgccugggcuaugagaccuuuaaagugaucgaaggguggucuaaccccaaguccaaacuccagauuaauagacaggucaucguggaccggggagaucgcagcggcuacucuggcauuuucuccgucgaggggaaaagcuguaucaacagaugcuuuuauguggaacugauucggggaagaaaggaggaaaccgagguucuguggacauccaauucuaucguggucuucuguggcaccagcgggacauacggaacgggcuccuggccugacggggcugaucucaaccugaugcccauuuga

SEQ ID NO: 208309 - RNA, 1410 nt, Artificial Sequence; identical to SEQ ID NO: 205946
  derived and/or modified sequence opt5 from neuraminidase__InfluenzaA__AHZ36460

SEQ ID NO: 208310 - RNA, 1410 nt, Artificial Sequence; identical to SEQ ID NO: 205946
  derived and/or modified sequence opt5 from neuraminidase__InfluenzaA__AHZ36472

SEQ ID NO: 208311 - RNA, 1410 nt, Artificial Sequence; identical to SEQ ID NO: 205946
  derived and/or modified sequence opt5 from neuraminidase__InfluenzaA__AHZ36484

SEQ ID NO: 208312 - RNA, 1410 nt, Artificial Sequence; identical to SEQ ID NO: 205946
  derived and/or modified sequence opt5 from neuraminidase__InfluenzaA__AHZ36496

SEQ ID NO: 208313 - RNA, 1410 nt, Artificial Sequence; identical to SEQ ID NO: 205946
  derived and/or modified sequence opt5 from neuraminidase__InfluenzaA__AHZ36508

SEQ ID NO: 208314 - RNA, 1410 nt, Artificial Sequence; identical to SEQ ID NO: 205946
  derived and/or modified sequence opt5 from neuraminidase__InfluenzaA__AHZ36520

SEQ ID NO: 208315 - RNA, 1410 nt, Artificial Sequence
  derived and/or modified sequence opt5 from neuraminidase__InfluenzaA__AHZ36532
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaccugguccaagccucagugugacauuacaggguucgcccccuuuucuaaagauaauagcauccgccucuccgcgggaggcgacaucugggugaccagagagccuuaugucucuugcgauccggacaaguguuaccaauucgcucuggggcagggaacaacccuuaacaaugugcauagcaacaauacgguucgggaucgcacacccuauagaacccugcucaugaacgaacugggcgugccuuuucaccuggggacaaagcaggucugcauugccugguccucuagcuccugucaugacggaaaagccuggcuccacgugugcaucaccggcgaugacaagaaugcuaccgccagcuucauuuacaacggccggcugguugauucuguggucuccuggagcaaagagauccuucgcacacaggaaucugagugugugugcauuaaugggacguguaccguggucaugacagacggauccgcuagcggcaaggccgauaccaaaauccuguuuaucgaggaagggaagauuguucauacauccacccucucuggaagcgcgcaacacguggaggaaugcuccugcuaucccagauacccuggcgugcggugugucugccgcgacaacuggaaggggagcaacagacccaucguggauauuaauaucaaagaccacucuauuguuuccagcuacguguguucuggacuggucggcgacacgccgcggaagaacgauagcuccucuagcucccauugccuugacccuaauaacgaggaaggcgggcacggagugaaaggcugggccuucgaugacgggaaugauguuuggaugggacgcacaaucaacgagaccagcagacugggcuaugagaccuuuaaggugaucgaaggguggucuaaucccaaauccaagcuccagauuaaccggcaggucaucguggaccgcggagauagaagcggcuacucuggcauuuucuccgucgaggggaaaagcuguaucaaucggugcuuuuauguggaacugauuagaggacgcaaggaggaaacagagguucuguggaccuccaacucuaucguggucuucuguggcacaagcgggacguacggaaccggcuccuggccugacggggcugaucucaaucugaugcccauuuga

SEQ ID NO: 208316 - RNA, 1410 nt, Artificial Sequence; identical to SEQ ID NO: 205946
  derived and/or modified sequence opt5 from neuraminidase__InfluenzaA__AHZ36544

SEQ ID NO: 208317 - RNA, 1410 nt, Artificial Sequence; identical to SEQ ID NO: 205946
  derived and/or modified sequence opt5 from neuraminidase__InfluenzaA__AHZ36556

SEQ ID NO: 208318 - RNA, 1410 nt, Artificial Sequence; identical to SEQ ID NO: 205946
  derived and/or modified sequence opt5 from neuraminidase__InfluenzaA__AHZ36568

SEQ ID NO: 208319 - RNA, 1410 nt, Artificial Sequence; identical to SEQ ID NO: 205946
  derived and/or modified sequence opt5 from neuraminidase__InfluenzaA__AHZ36580

SEQ ID NO: 208320 - RNA, 1410 nt, Artificial Sequence; identical to SEQ ID NO: 205946
  derived and/or modified sequence opt5 from neuraminidase__InfluenzaA__AHZ36592

SEQ ID NO: 208321 - RNA, 1410 nt, Artificial Sequence; identical to SEQ ID NO: 205946
  derived and/or modified sequence opt5 from neuraminidase__InfluenzaA__AHZ36604

SEQ ID NO: 208322 - RNA, 1410 nt, Artificial Sequence; identical to SEQ ID NO: 205946
  derived and/or modified sequence opt5 from neuraminidase__InfluenzaA__AHZ36616

SEQ ID NO: 208323 - RNA, 1410 nt, Artificial Sequence
  derived and/or modified sequence opt5 from neuraminidase__InfluenzaA__AHZ36628
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacccgcugaguaucggaauugguccaagccucagugcgacauuaccggguucgcccccuuuucuaaagauaacagcauccgccucuccgcgggaggcgacaucugggugacaagagagccuuacgucucuugugauccggacaagugcuaucaauucgcucuggggcagggaaccacacuuaauaacgugcauagcaauaacaccguucgggaucgcacgcccuacagaacacugcucaugaaugaacugggcgugccuuuucaccuggggaccaagcaggucuguauugccugguccucuagcuccugccaugacggaaaagccuggcuccacguguguaucacaggcgaugacaagaacgcuaccgccagcuucauuuauaauggccggcugguugauucuguggucuccuggagcaaagagauccuucgcacccaggaaucugagugcguguguauuaacgggacaugcacgguggucaugaccgacggauccgcuagcggcaaggccgauacaaaaauccuguuuaucgaggaagggaagauuguucauaccuccacacucucuggaagcgcgcaacacguggaggaaugcuccuguuaccccagauauccuggcgugcggugcgucugucgcgacaacuggaaggggagcaauagacccaucguggauauuaacaucaaagaccacucuauuguuuccagcuacgugugcucuggacuggucggcgacaccccgcggaagaaugauagcuccucuagcucccauugucuugacccuaacaaugaggaaggcgggcacggagugaaaggcugggccuucgaugacgggaacgauguuuggaugggacgcacgaucaaugagacaagcagacugggcuacgagaccuuuaaggugaucgaaggguggucuaaccccaaauccaagcuccagauuaaucggcaggucaucguggaccgcggagauagaagcggcuauucuggcauuuucuccgucgaggggaaaagcugcaucaaccgguguuuuuacguggaacugauuagaggacgcaaggaggaaaccgagguucuguggacauccaauucuaucguggucuucugcggcaccagcgggacauauggaacgggcuccuggccugacggggcugaucucaaccugaugcccauuuga

SEQ ID NO: 208324 - RNA, 1410 nt, Artificial Sequence
  derived and/or modified sequence opt5 from neuraminidase__InfluenzaA__AHZ36640
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucacgaucggacgcccuaucgcacacugcucaugaaugaacugggcgugccuuuucaucuggggaccaagcaggucugcauugccugguccucuagcuccugucacgacggaaaagccuggcuccaugugugcaucacaggcgaugacaagaacgcuaccgccagcuucauuuacaauggcagacugguugauucuguggucuccuggagcaaagagauccuucggacccaggaaucugagugugugugcauuaacgggacauguacgguggucaugaccgacggauccgcuagcggcaaggccgauacaaaaauccuguuuaucgaggaagggaagauuguucacaccuccacacucucuggaagcgcgcaacacguggaggaaugcuccugcuauccccgcuacccuggcgugagaugugucugccgggacaacuggaaggggagcaaucgccccaucguggauauuaacaucaaagaccauucuauuguuuccagcuacguguguucuggacuggucggcgacaccccgagaaagaaugauagcuccucuagcucccacugccuugacccuaacaaugaggaaggcgggcauggagugaaaggcugggccuucgaugacgggaacgauguuuggaugggacggacgaucaaugagacaagccgccugggcuaugagaccuuuaaggugaucgaaggguggucuaaccccaaauccaagcuccagauuaauagacaggucaucguggaccggggagaucgcagcggcuacucuggcauuuucuccgucgaggggaaaagcuguaucaacagaugcuuuuauguggaacugauucggggaagaaaggaggaaaccgagguucuguggacauccaauucuaucguggucuucuguggcaccagcgggacauacggaacgggcuccuggccugacggggcugaucucaaccugaugcccauuuga

SEQ ID NO: 208325 - RNA, 1410 nt, Artificial Sequence; identical to SEQ ID NO: 205946
  derived and/or modified sequence opt5 from neuraminidase__InfluenzaA__AHZ36652

SEQ ID NO: 208326 - RNA, 1410 nt, Artificial Sequence; identical to SEQ ID NO: 205170
  derived and/or modified sequence opt5 from neuraminidase__InfluenzaA__AHZ36664

SEQ ID NO: 208327 - RNA, 1410 nt, Artificial Sequence; identical to SEQ ID NO: 205170
  derived and/or modified sequence opt5 from neuraminidase__InfluenzaA__AHZ36676

SEQ ID NO: 208328 - RNA, 1410 nt, Artificial Sequence; identical to SEQ ID NO: 205170
  derived and/or modified sequence opt5 from neuraminidase__InfluenzaA__AHZ36688

SEQ ID NO: 208329 - RNA, 1398 nt, Artificial Sequence; identical to SEQ ID NO: 206478
  derived and/or modified sequence opt5 from neuraminidase__InfluenzaA__AHZ39689

SEQ ID NO: 208330 - RNA, 1398 nt, Artificial Sequence; identical to SEQ ID NO: 206478
  derived and/or modified sequence opt5 from neuraminidase__InfluenzaA__AHZ39713

SEQ ID NO: 208331 - RNA, 1398 nt, Artificial Sequence; identical to SEQ ID NO: 206478
  derived and/or modified sequence opt5 from neuraminidase__InfluenzaA__AHZ39725

SEQ ID NO: 208332 - RNA, 1398 nt, Artificial Sequence; identical to SEQ ID NO: 206478
  derived and/or modified sequence opt5 from neuraminidase__InfluenzaA__AHZ39737

SEQ ID NO: 208333 - RNA, 1398 nt, Artificial Sequence
  derived and/or modified sequence opt5 from neuraminidase__InfluenzaA__AHZ39749
augaaccccaaucagaagauccugugcauuagcgccaccgcuaucauuaucggcgccauugcggugcucaucgggaucgcuaaccugggacuuaauauuggccugcaccucaaaccuggguguaacugcucccauucucaaccggagacaacgaauaccagccagacaaucauuaacaauuacuauaacgaaaccaauaucacaaacauucagauggaggaaagaaccucccggaauuucaacaaucugacaaagggacuuuguaccaucaacucuuggcacauuuacggcaaagacaaugccguccgcaucggggagagcuccgauguucuggugacgagagaacccuaugugucuugcgacccugaugagugucgguuuuacgcccucagccagggaaccacaauccgcggcaagcauuccaacggcaccauucacgacagaagccaauaucgggcucugaucucuuggccccuguccagcccucccacagucuacaacucucgcguggagugcauugggugguccagcaccucuugucaugauggaaaauccagaaugagcaucugcauuuccggcccuaauaacaaugccucugcuguugugugguauaaccggcgcccggucgccgaaaucaauacgugggcgagaaacauccuccggacacaggagagcgaaugugugugccacaaugggguuugucccguggucuucaccgacggauccgccacaggcccugcugauacccgcauuuacuacuuuaaggaggggaagauccugaaaugggagagccuuaccggaacagccaagcacauugaagagugcucuugcuauggcgaaagaacgggcaucaccuguacaugccgggacaacuggcagggguccaaucgccccgugauucagaucgauccuguggcuaugacccauacaagccaauacaucuguucucccguccugaccgacaacccgagaccuaaugaucccaacauuggaaaaugcaaugacccuuaucccggcaacaauaacaacgggguuaagggauucagcuaccucgauggcgccaauacguggcuggggcggacaaucuccaccgcgucuagaagcggauaugagaugcuuaaagugcccaacgcccugaccgacgaccgcuccaagccuauucagggccagacaaucgugcucaaugcugauuggagcggcuacucuggguccuuuauggacuauugggccgaaggagauuguuaccgggcuugcuucuacgucgagcugauuagaggccgcccgaaggaggacaaagugugguggaccagcaacucuaucguuuccauguguagcuccacagaauuucuggggcaguggaauuggcccgauggagccaagauugaguauuuccucuga

SEQ ID NO: 208334 - RNA, 1398 nt, Artificial Sequence; identical to SEQ ID NO: 208333
  derived and/or modified sequence opt5 from neuraminidase__InfluenzaA__AHZ39761

SEQ ID NO: 208335 - RNA, 1398 nt, Artificial Sequence; identical to SEQ ID NO: 206478
  derived and/or modified sequence opt5 from neuraminidase__InfluenzaA__AHZ39773

SEQ ID NO: 208336 - RNA, 1398 nt, Artificial Sequence; identical to SEQ ID NO: 206478
  derived and/or modified sequence opt5 from neuraminidase__InfluenzaA__AHZ39785

SEQ ID NO: 208337 - RNA, 1410 nt, Artificial Sequence
  derived and/or modified sequence opt5 from neuraminidase__InfluenzaA__AHZ39797
augaaccccaaucagaagaucauuaccaucggcagcgugucccugacaauuucuacggucugcuucuuuaugcaaaucgccauucucaucaccacaguuacccugcacuucaaacaguacgaguuuaacccuccgcccaauaaccaggugaugcuuugugaaccuacaaucauugagagaaauaucaccgaaauuguguaucugacaaacaccacgaucgagaaggaaauuugccccaaaccugcugaguaccggaauuggagcaagccccagugugggaucaccggauucgccccuuuuuccaaagacaacucuauucgccucagcgcgggcggggauaucugggucacaagagagccguauguguccugcgaccccgauaaguguuaccaauucgcucugggacagggcaccacacuuaauaacguucauucuaauaacaccgugcgggaccgcacgccuuauagaacacugcucaugaaugaacuggggguccccuuucaccugggaaccaaacaggugugcaucgccuggagcuccagcucuugucaugauggcaaggccuggcuccacguuugcauuacaggcgacgauaagaacgcuaccgccuccuucaucuacaaugggcggcugguggacagcgucgugucuugguccaaagagauucuucgcacccaggaaagcgagugugugugcaucaacggaacauguacggucguuaugaccgauggcucugcuuccggaaagagcgacacaaaaauucuguuuaucgaggaagggaagaucgugcauaccuccacacucucuggcagcgcccaacacguggaggaaugcuccugcuauccuagauaccccgggguccggugugugugccgcgauaacuggaagggaagcaauagaccgauuguugacaucaacauuaaagaucacucuaucguguccagcuacgucuguucuggccuggugggcgacaccccucggaagaaugacagcuccucuagcucccauugccuugaucccaacaaugaggaagggggacacggcguuaaagggugggcguucgacgauggaaacgacguguggaugggccgcacgauuaaugagacaagcagacugggguaugagaccuuuaaggucaucgaaggauggucuaacccuaaauccaagcuccagaucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggcccgauggcgccgaccucaaccugaugcccaucuga

SEQ ID NO: 208338 - RNA, 1410 nt, Artificial Sequence
  derived and/or modified sequence opt5 from neuraminidase__InfluenzaA__AHZ39821
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccagcagcuccugucaugacggaaaagccuggcugcacgugugcauuaccggcgaugacaagaacgcuaccgccagcuucaucuacaauggccggcuuguugauucuguggucuccuggagcaaagagauucugcgcacacaggaaucugagugugugugcaucaacgggacguguaccguggucaugacagacggauccgcuagcggcaaggccgauaccaaaauucucuuuaucgaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggcgcaaugauagcuccucuagcucccauugccuggacccgaacaaugaggaaggcgggcacggagugaagggcugggccuucgaugacgggaacgauguuuggaugggaagaacaauuaaugagaccagccggcucggcuaugagaccuuuaaagugaucgaaggguggucuaacccuaaguccaaacugcagaucaaucgccaggucauuguggacagaggaaaccggagcggcuacucuggcaucuucuccgucgaggggaagucuuguauuaauagaugcuuuuauguggaacugauccgcggacggaaagaggaaacagagguucucuggaccuccaacucuauuguggucuucuguggcacaagcgggacguacggaaccggcuccuggcccgauggggcugaccugaaucuuaugccuacauga

SEQ ID NO: 208339 - RNA, 1410 nt, Artificial Sequence; identical to SEQ ID NO: 206413
  derived and/or modified sequence opt5 from neuraminidase__InfluenzaA__AHZ39833

SEQ ID NO: 208340 - RNA, 1410 nt, Artificial Sequence; identical to SEQ ID NO: 205170
  derived and/or modified sequence opt5 from neuraminidase__InfluenzaA__AHZ39844

SEQ ID NO: 208341 - RNA, 1410 nt, Artificial Sequence
  derived and/or modified sequence opt5 from neuraminidase__InfluenzaA__AHZ39856
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguacguguguagcggacuggucggcgacaccccgcgcaagaaugauucuagcuccucuagccauugccuugacccuaacaaugaggaaggcgggcacggagugaaaggcugggccuucgaugacgggaacgauguuuggaugggaagaacgaucaaugagacaucccggcugggcuaugagaccuuuaaggugaucgaaggguggagcaaccccaaaucuaagcucccuauuaaucgccaggucaucguggacagaggagaucgguccggcuacagcggcauuuucucugucgaggggaaauccuguaucaacagaugcuuuuauguggaacugauucgcggacggaaggaggaaaccgagguucuguggacaagcaauuccaucguggucuucuguggcaccucugggacauacggaacgggcagcuggcccgacggggcugaucucaaccugaugcccauuuga

SEQ ID NO: 208342 - RNA, 1410 nt, Artificial Sequence; identical to SEQ ID NO: 205170
  derived and/or modified sequence opt5 from neuraminidase__InfluenzaA__AHZ39868

SEQ ID NO: 208343 - RNA, 1410 nt, Artificial Sequence
  derived and/or modified sequence opt5 from neuraminidase__InfluenzaA__AHZ39892
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcauugccugguccucuagcuccugucaugacggaaaggccuggcuccacguuugcaucacaggcgaugacaagaacgcuaccgccagcuucauuuacaauggccggcugguggauucugucguguccuggagcaaagagauccuucgcacccaggaaucugagugugugugcauuaacgggacauguacggucguuaugaccgacggauccgcuagcggcaaggccgauacaaaaauccuguuuaucgaggaagggaagauugugcauaccuccacacucucuggaagcgcgcaacacguggaggaaugcuccugcuaucccagauacccuggcguccggugugugugccgcgacaacuggaaggggagcaauagacccaucguugauauuaacaucaaagaccacucuauugugucccgguacgucuguagcggacuggugggcgacaccccgcgcaagaaugauucuagcuccucuagccauugccuugacccuaacaaugaggaaggcgggcacggaguuaaaggcugggccuucgaugacgggaacgauguguggaugggaagaacgaucaaugagacaucccggcugggcuaugagaccuuuaaggucaucgaaggguggagcaaccccaaaucuaagcuccagauuaaucgccaggugaucgucgacagaggagaucgguccggcuacagcggcauuuucucuguggaggggaaauccuguaucaacagaugcuuuuauguugaacugauucgcggacggaaggaggaaaccgaggugcuguggacaagcaauuccaucgucguguucuguggcaccucugggacauacggaacgggcagcuggccugacggggcugaucucaaccugaugcccauuuga

SEQ ID NO: 208344 - RNA, 1410 nt, Artificial Sequence; identical to SEQ ID NO: 206378
  derived and/or modified sequence opt5 from neuraminidase__InfluenzaA__AHZ39904

SEQ ID NO: 208345 - RNA, 1410 nt, Artificial Sequence; identical to SEQ ID NO: 206378
  derived and/or modified sequence opt5 from neuraminidase__InfluenzaA__AHZ39916

SEQ ID NO: 208346 - RNA, 1410 nt, Artificial Sequence; identical to SEQ ID NO: 205170
  derived and/or modified sequence opt5 from neuraminidase__InfluenzaA__AHZ39928

SEQ ID NO: 208347 - RNA, 1410 nt, Artificial Sequence
  derived and/or modified sequence opt5 from neuraminidase__InfluenzaA__AHZ39940
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcaucgccugguccucuagcuccugucaugauggcaaagccuggcuccacgugugcauuacaggcgacgauaagaacgcuaccgccagcuucaucuacaaugggcggcugguugacucuguggucuccuggagcaaagagauucuucgcacccaggaaucugagugugugugcaucaacggaacauguacgguggucaugaccgauggcuccgcuagcgggaaggccgacacaaaaauucuguuuaucgaggaaggaaagaucguucauaccuccacacucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacaccccgcggaagacggacagcuccucuagcucccauugccuugauccuaauaacgaggaagggggacacggcgugaaagggugggccuucgacgauggaaaugacguuuggaugggccgcacaauuaacgagaccagcagacugggguaugagaccuuuaaggugaucgaaggauggucuaaucccaaauccaagcuccagaucaaccggcaggucauuguggaucgcggcgacagaagcggcuacucugggaucuucuccgucgagggaaaaagcuguauuaaucggugcuuuuauguggaacugaucagaggccgcaaggaggaaacagagguucuguggaccuccaacucuauuguggucuucugugggacaagcggaacguacggcaccggguccuggccugauggcgcugaccucaaucugaugcccaucuga

SEQ ID NO: 208348 - RNA, 1410 nt, Artificial Sequence; identical to SEQ ID NO: 205170
  derived and/or modified sequence opt5 from neuraminidase__InfluenzaA__AHZ39952

SEQ ID NO: 208349 - RNA, 1410 nt, Artificial Sequence; identical to SEQ ID NO: 205170
  derived and/or modified sequence opt5 from neuraminidase__InfluenzaA__AHZ39976

SEQ ID NO: 208350 - RNA, 1410 nt, Artificial Sequence
  derived and/or modified sequence opt5 from neuraminidase__InfluenzaA__AHZ39988
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcacccaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacacgccgcggaagaaugacagcuccucuagcucccauugccuugauccuaacaaugaggaagggggacacggcgucaaagggugggcguucgacgauggaaacgacguguggaugggccgcacaaucaaugagaccagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaacagaggugcuguggaccuccaauucuaucguuguguucugugggacaagcggaacguacggcaccggguccuggccugauggcgccgaccucaaccugaugcccauuuga

SEQ ID NO: 208351 - RNA, 1410 nt, Artificial Sequence; identical to SEQ ID NO: 205170
  derived and/or modified sequence opt5 from neuraminidase__InfluenzaA__AHZ40000

SEQ ID NO: 208352 - RNA, 1410 nt, Artificial Sequence; identical to SEQ ID NO: 205170
  derived and/or modified sequence opt5 from neuraminidase__InfluenzaA__AHZ40012

SEQ ID NO: 208353 - RNA, 1410 nt, Artificial Sequence
  derived and/or modified sequence opt5 from neuraminidase__InfluenzaA__AHZ40024
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccuccucuuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguuugagaccuucaaggugaucgaaggauggucuaaccccaaauccaagcuccagauuaaucggcaggucaucguggaucgcggcgacagaagcggcuauucugggauuuuuagcgucgagggaaaaagcuguaucaaccggugcuucuacguggaacugauuagaggccgcaaggaggaaaccgagguucuguggacauccaauucuaucguggucuucugugggaccagcggaacauauggcacgggguccuggccugauggcgcugaccucaaccugaugcccauuuga

SEQ ID NO: 208354 - RNA, 1410 nt, Artificial Sequence; identical to SEQ ID NO: 205170
  derived and/or modified sequence opt5 from neuraminidase__InfluenzaA__AHZ40036

SEQ ID NO: 208355 - RNA, 1410 nt, Artificial Sequence; identical to SEQ ID NO: 206381
  derived and/or modified sequence opt5 from neuraminidase__InfluenzaA__AHZ40048

SEQ ID NO: 208356 - RNA, 1410 nt, Artificial Sequence; identical to SEQ ID NO: 205170
  derived and/or modified sequence opt5 from neuraminidase__InfluenzaA__AHZ40063

SEQ ID NO: 208357 - RNA, 1410 nt, Artificial Sequence
  derived and/or modified sequence opt5 from neuraminidase__InfluenzaA__AHZ40075
augaaccccaaucagaagaucauuaccaucggcagcgugucccugacaauuucuacggucugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaacuccaaaagcaagcuccagaucaaucgccaggugauugucgaucggggcgacagaucuggcuacuccgggaucuucagcguggagggaaaauccuguauuaaccggugcuuuuauguugaacugaucagaggccgcaaggaggaaaccgaggugcuguggacaucuaauagcauugucguguucugugggaccuccggaacauacggcacggggucuuggcccgauggcgcugaccucaaccugaugccuaucuga

SEQ ID NO: 208358 - RNA, 1410 nt, Artificial Sequence; identical to SEQ ID NO: 205170
  derived and/or modified sequence opt5 from neuraminidase__InfluenzaA__AHZ40087

SEQ ID NO: 208359 - RNA, 1410 nt, Artificial Sequence; identical to SEQ ID NO: 206381
  derived and/or modified sequence opt5 from neuraminidase__InfluenzaA__AHZ40099

SEQ ID NO: 208360 - RNA, 1410 nt, Artificial Sequence
  derived and/or modified sequence opt5 from neuraminidase__InfluenzaA__AHZ40111
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggugacaagagagccuuaugucuccugcgauccggacaaguguuaccaauucgcucuugggcagggaaccacacugaauaacgugcauucuaauaacaccguucgggaucgcacgcccuauagaacacuccugaugaaugaacugggcgugccuuuucaccucgggaccaagcaggucugcauugccuggagcuccagcucuugucaugacggaaaagccuggcugcacgugugcaucacaggcgaugacaagaacgcuaccgccuccuucauuuacaauggccggcuuguugauagcguggucucuugguccaaagacauccugcgcacccaggagagcgaaugugugugcauuaacgggacaugugcuguggucaugacggauggaucugccuccggcaaggcggacaccaaaauccucuuuaucgaggaggggaagauuguucauacaagcacccuguccggaucugcccaacacguggaagagugcagcugcuaucccagauacccuggcgugcggugugucugccgcgauaacuggaagggguccaauagacccaucguggacauuaacaucaaagaccacagcauuguuucuuccuacguguguagcggacuugucggcgauacaccgcggaagaaugacucuagcuccucuggccauugccuggauccuaacaaugaagagggaggacacggcgugaaagggugggcuuucgacgauggaaacgacguuuggaugggccgcaccaucaaugaaacgagcagacucggguaugagacauuuaaggugaucgagggaugguccaaccccaaaagcaagcugcagauuaaucggcaggucaucguggaucgcggcaacagaucuggcuacuccgggauuuucagcgucgaagggaaaaauuguaucaaccggugcuuuuauguggagcugauuagaggccgcaaggaagagaccgaaguucucuggaccucuaauuccaucguggucuucugugggacaagcggaaccuacggcacaggguccuggccugacggcgccgaucugaaccuuaugcccauuuga

SEQ ID NO: 208361 - RNA, 1410 nt, Artificial Sequence
  derived and/or modified sequence opt5 from neuraminidase__InfluenzaA__AHZ40123
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaccgagagaaauaucacagaaauuguguaucugaccaacacgaccaucgagaaggaaauuugcccuaaacccgcugaguaccggaauugguccaagccucagugugggaucacaggauucgcccccuuuucuaaagacaacagcauucgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcaucgccugguccucuagcuccugucaugauggcaaagccuggcuccacgugugcauuaccggcgacgauaagaacgcuaccgccagcuucaucuacaaugggcggcugguugacucuguggucuccuggagcaaagagauucuucgcacacaggaaucugagugugugugcaucaacggaacguguaccguggucaugacagauggcuccgcuagcgggaaggccgacaccaaaauucuguuuaucgaggaaggaaagaucguucauacaagaacccucuccggcucugcgcaacacguggaggaaugcagcugcuauccccgguacccuggggugcgcugugucugcagagauaacuggaagggauccaaucggcccauuguggacaucaacauuaaagaucacagcaucguuucuuccuacguguguagcggccuggucggcgacacgccgcgcaagaaugacucuagcuccucuagccauugccuugauccuaacaaugaggaagggggacacggcgugaaagggugggccuucgacgauggaaacgacguuuggaugggcagaacaauuaaugagaccucccggcugggguaugagaccuuuaaggugaucgaaggauggagcaaccccaaaucuaagcuccagaucaaucgccaggucauuguggauagaggcgaccgguccggcuacagcgggaucuucucugucgagggaaaauccuguauuaacagaugcuuuuauguggaacugauccgcggccggaaggaggaaacagagguucuguggaccagcaauuccauuguggucuucugugggacaucuggaacguacggcaccgggagcuggccugauggcgcugaccucaaccugaugcccaucuga

SEQ ID NO: 208362 - RNA, 1410 nt, Artificial Sequence; identical to SEQ ID NO: 205170
  derived and/or modified sequence opt5 from neuraminidase__InfluenzaA__AHZ40133

SEQ ID NO: 208363 - RNA, 1410 nt, Artificial Sequence; identical to SEQ ID NO: 206388
  derived and/or modified sequence opt5 from neuraminidase__InfluenzaA__AHZ40145

SEQ ID NO: 208364 - RNA, 1410 nt, Artificial Sequence
  derived and/or modified sequence opt5 from neuraminidase__InfluenzaA__AHZ40157
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaacucugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcauggccugguccagcagcuccugucaugacggaaaagccuggcuucacgugugcaucacaggcgaugacaagaacgcuaccgccagcuucauuuacaauggcaaacugguugauucuguggucuccuggagcaaggagauccuccggacccaggaaucugagugugugugcauuaacgggacauguacgguggucaugaccgacggauccgcuagcggcaaagccgauacaaagauccuguuuauugaggaagggaagaucguucauaccuccacacuuucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuggucggcgacacccccagaaaaacggauagcuccucuagcucccauugccucgacccgaauaacgaggaaggcgggcacggagugaagggcugggccuucgaugacgggaaugauguuuggaugggacggacaaucaacgagaccagccgccugggcuaugagaccuuuaaagugauugaaggguggucuaauccuaaguccaaacugcagaucaacagacaggucaucguggaccggggagaucgcagcggcuacucuggcauuuucuccgucgaggggaagucuuguaucaauagaugcuuuuauguggaacucauucggggaagaaaggaggaaacagcuguucuguggaccuccaacucuaucguggucuucuguggcacaagcgggacguacggaaccggcuccuggcccgacggggccgaucuuaaucugaugccuauuuga

SEQ ID NO: 208365 - RNA, 1410 nt, Artificial Sequence
  derived and/or modified sequence opt5 from neuraminidase__InfluenzaA__AHZ40169
augaaccccaaucagaagaucauuaccaucggcagcgugugcaugacaauugggauggccaaccugauccuccaaauuggaaauaucaucuccauuuggaucucucacagcauucagcuggagaaccagucccagaucgaaacguguaaucaaucugucauuaccuacgagaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccgugagaaucggcagcaaaggggaugucuuugugauccgggaaccguucauuucuuguagcccccucgagugccgcaccuuuuuccugacacagggagcccuucugaacgacaagcauuccaauggcaccaucaaagauagaucuccuuaucggacgcucauguccugucccauuggcgaaguuccuagccccuacaacucccgcuuugagucuguggccuggagcgcuuccgccugccacgacgggaucaacuggcugaccauuggaaucagcggcccugauucuggggcugucgccgugcugaaguauaauggaaucauuacagacaccaucaaguccuggagaaacaauauucuccggacacaagagagcgaaugugcgugcgugaacggcucuuguuucaccaucaugacggaugggccgagcgacggacaggccuccuacaaaauuuuucgcaucgagaagggcaaaaucgucaagucuguugaaaugaaugcucccaacuaucauuacgaggagugcagcuguuacccugauuccagcgaaauuacaugcgugugcagagacaauuggcacggcucuaaccggcccuggguguccuucaaucagaaccuggaguaucagaucggguacauuuguagcggaaucuuuggcgauaauccucgccccaacgacaaaaccgggucuugcggaccggucuccagcaauggcgccaacggggugaagggauucuccuuuaaguauggcaauggcguuuggauugggagaacaaaaucuaucagcucccggaagggauucgaaaugauuugggauccuaacggcuggaccgggaccgacaacaauuuuucuaucaaacaagacaucgugggaauuaacgaguggagcggcuacuccgggagcuucguccagcaucccgaacuuacaggccuggauuguauccgcccuugcuucuggguggagcucauuagaggacggcccaaggagaauacgaucuggaccucuggcuccagcauuucuuuuugugggguuaacuccgacacagugggauggagcuggcccgauggcgcugaacugccuuucaccaucgacaaauga

SEQ ID NO: 208366 - RNA, 1410 nt, Artificial Sequence
  derived and/or modified sequence opt5 from neuraminidase__InfluenzaA__AHZ40180
augaaccccaaucagaagaucauuaccaucggcagcgugucccugacaauuucuacgaucugcuucuuuaugcaaauuaccauccucaucacaaccgucacacugcacuucaaacaguacgaguuuaacagcccuccgaauaaccagguuaugcuuugugaacccaccauuaucgagagaaauauuacagaaaucguguaucugaccaacacgaccauugagaaggaaaucugcccuaaacccgccgaguaccggaauugguccaagccucagugugggauuacaggauucgcucccuuuucuaaagacaacagcauccgccucuccgccggcggggauaucugggugaccagagagccuuaugucucuugcgacccggauaaguguuaccaauucgcgcugggacagggcacaacccuuaauaacgugcauagcaauaacacgguucgggaccgcacacccuauagaacccugcucaugaaugaacugggggugccuuuucaccugggaacaaagcaggucugcauugcuugguccucuagcuccugucaugauggcaaagccuggcuccacgugugcaucaccggcgacgauaagaacgccaccgcuagcuucauuuacaaugggcggcugguugacucuguggucuccuggagcaaagagauccuucgcacacaggaaucugagugugugugcauuaacggaacguguaccguggucaugacagauggcuccgccagcgggaaggcugacaccaaaauccuguuuaucgaggaaggaaagauuguucauacauccacccucucuggcagcgcccaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacacgccgcggaagaaugacagcuccucuagcucccauugccuugauccuaacaaugaggaagggggacacggcgugaaagggugggcguucgacgauggaaacgacguuuggaugggccgcacaaucaaugagaccagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaacagagguucuguggaccuccaauucuaucguggucuucugugggacaagcggaacguacggcaccggguccuggccugauggcgccgaccucaaccugaugcccauuuga

SEQ ID NO: 208367 - RNA, 1410 nt, Artificial Sequence; identical to SEQ ID NO: 206034
  derived and/or modified sequence opt5 from neuraminidase__InfluenzaA__AHZ40192

SEQ ID NO: 208368 - RNA, 1410 nt, Artificial Sequence; identical to SEQ ID NO: 205170
  derived and/or modified sequence opt5 from neuraminidase__InfluenzaA__AHZ40204

SEQ ID NO: 208369 - RNA, 1410 nt, Artificial Sequence; identical to SEQ ID NO: 205170
  derived and/or modified sequence opt5 from neuraminidase__InfluenzaA__AHZ40216

SEQ ID NO: 208370 - RNA, 1410 nt, Artificial Sequence; identical to SEQ ID NO: 206399
  derived and/or modified sequence opt5 from neuraminidase__InfluenzaA__AHZ40228

SEQ ID NO: 208371 - RNA, 1410 nt, Artificial Sequence
  derived and/or modified sequence opt5 from neuraminidase__InfluenzaA__AHZ40240
augaaccccaaucagaagaucauuaccaucggcagcgugucccugacaauuucuacgaucugcuuccucaugcaaauugccauccugaucaccacagcuacccuucacuuuaaacaguacgaguucaacagcccuccgaauaaccaggucaugcugugugaacccacaauuaucgagagaaauauuaccgaaaucguuuaucucacaaacaccacgauugagaaggaaaucugcccuaaacccgccgaguaccggaauugguccaagccucagugugggauuaccggauuugcgcccuucucuaaagacaacagcauccgccuguccgcuggcggggauaucugggugacaagagagccuuaugugucuugcgacccggauaaguguuaccaauuugcccuuggacagggcaccacacugaauaacguccauagcaauaacaccgugcgggaccgcacgcccuauagaacacuccugaugaaugaacuggggguuccuuuccaccucggaaccaaacaggugugcauugccugguccuccucuuccugucaugauggcaaggcuuggcugcacgucugcaucacaggcgacgauaagaacgccaccgcuagcuuuauuuacaaugggcggcuuguggacucuguuguguccuggagcaaagagauccugcgcacccaggaaucugagugugucugcauuaacggaacauguacgguggugaugaccgauggcuccgccagcgggaaggcggacacaaaaauccucuucaucgaggaaggaaagauuguccauaccuccacacugucuggcagcgcccaacacguugaggaaugcuccugcuaucccagauacccuggggugcggugugugugccgcgauaacuggaagggaagcaauagacccaucgucgacauuaacaucaaagaucggucuauuguguccagcuacguuuguucuggccuugugggcgacaccccgcgcaagaaugacagcuccucuagcucccacugccuggauccuaacaaugaggaagggggacauggcgucaaagggugggcuuuugacgauggaaacgacguguggaugggcagaacgaucaaugagacaagccggcucggguaugagaccuucaagguuaucgaaggauggucuaaccccaaauccaagcugcagauuaaucgccaggugaucgucgauagaggcgaccggagcggcuacucugggauuuuuagcguggagggaaaaagcuguaucaacagaugcuucuaugucgaacugauucgcggccggaaggaggaaaccgaggugcucuggacauccaauucuaucguuguguuuugugggaccagcggaacauacggcacgggguccuggccugauggcgccgaccugaaccuuaugcccauuuga

SEQ ID NO: 208372 - RNA, 1410 nt, Artificial Sequence
  derived and/or modified sequence opt5 from neuraminidase__InfluenzaA__AHZ40252
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgaggacaagaacgcuaccgccagcuucauuuacaaugggcggcugguugauucuaucguguccuggagcaaagaaauucuucgcacccaggagucugagugugucugcaucaacggaacauguacgguggugaugaccgacggcuccgcuagcgggaaggccgauacaaaaauccuguuuauugaagagggaaagaucguccauaccuccacacucucuggcagcgcgcaacacguugaagagugcuccugcuaucccagauacccuggggugcggugugugugccgcgacaacuggaagggaagcaauagacccauugucgauaucaacauuaaagaccacucuaucguguccagcuacguuuguucuggccuggugggcgauaccccgcggaagaaugacagcuccucuagcucccauugccuugacccuaacaaugaagaagggggacacggcgucaaagggugggccuucgaugacggaaacgauguguggaugggccgcacgaucaaugagacaagcagacugggguaugagaccuuuaagguuauugagggauggucuaaccccaaauccaagcuccagaucaaucgccaggugauugucgaccggggcgauagaagcggcuacucugggaucuucuccguggaaggaaaaagcuguauuaaccggugcuuuuaugucgagcugaucagaggccgcaaggaagagaccgaggugcuguggacauccaauucuauuguuguguucugugggaccagcggaacauacggcacgggguccuggccugacggcgcugaucucaaccugaugcccaucuga

SEQ ID NO: 208373 - RNA, 1410 nt, Artificial Sequence; identical to SEQ ID NO: 208118
  derived and/or modified sequence opt5 from neuraminidase__InfluenzaA__AHZ40264

SEQ ID NO: 208374 - RNA, 1410 nt, Artificial Sequence; identical to SEQ ID NO: 205170
  derived and/or modified sequence opt5 from neuraminidase__InfluenzaA__AHZ40276

SEQ ID NO: 208375 - RNA, 1410 nt, Artificial Sequence
  derived and/or modified sequence opt5 from neuraminidase__InfluenzaA__AHZ40288
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucugugaucuccuggagcaaagacauucugcgcacccaggagucugaaugugucugcaucaacgggacaugugcuguggugaugacggauggauccgccagcggcaaggcggacaccaaaauccucuuuauugaggaggggaagaucguccauacauccacccugucuggaagcgcccaacacguugaagagugcuccugcuauccuagauaccccggcgugcggugugugugccgcgauaacuggaaggggagcaauagaccuauugucgacaucaacauuaaagaccacucuaucguguccagcuacguuuguucuggacuugugggcgauacaccccggaagaaugacagcuccucuagcggccauugccuggauccgaacaaugaagagggaggacacggcgucaaagggugggcuuucgacgauggaaacgacguguggaugggccgcaccaucaaugaaacguccagacucggguaugagacauuuaagguuauugagggauggagcaacccuaaaucuaagcugcagaucaaucgccaggugauugucgaucggggcaacagauccggcuacagcgggaucuucucuguggaagggaaaaauuguauuaaccggugcuuuuaugucgagcugaucagaggccgcaaggaagagaccgaagugcucuggaccuccaauagcauuguuguguucugugggacauccggaaccuacggcacagggucuuggcccgacggcgccgaucugaaccuuaugccuaucuga

SEQ ID NO: 208376 - RNA, 1410 nt, Artificial Sequence
  derived and/or modified sequence opt5 from neuraminidase__InfluenzaA__AHZ40312
augaaccccaaucagaagaucauuaccaucggcagcgugucccugacaauuucuacgaucugcuucuuuaugcaaauugccauccucaucaccacagucacccugcacuucaaacaguacgaguuuaacuauccuccgaauaaccagguuaugcuuugugaacccacaauuaucgagagaaauauuaccgaaaucguguaccugacaaacaccacgauugagaaggaaaucugcccuaaacccgcugaguaucggaauuggagcaagccucagugugggauuaccggauucgcccccuuuuccaaagacaacucuauccgccucagcgcgggcggggauaucugggugacaagagagccuuacgucuccugcgacccggauaaguguuaucaauucgcucugggacagggcaccacacuuaauaacgugcauucuaauaacaccguucgggaccgcacgcccuacagaacacugcucaugaaugaacugggggugccuuuucaccugggaaccaagcaggucugcauugccuggagcuccagcucuugucaugauggcaaagccuggcuccacgugugcaucacaggcgacgauaagaacgcuaccgccuccuucauuuauaaugggcggcugguugacagcguggucucuugguccaaagagauccuucgcacccaggaaagcgagugugugugcauuaacggaacauguacgguggucaugaccgauggcucugcuuccgggaaggccgacacaaaaauccuguuuaucgaggaaggaaagauuguucauaccagcacacucuccggcucugcgcaacacguggaggaaugcagcugcuaccccagauacccuggggugcggugugucugccgcgauaacuggaagggauccaauagacccaucguggacauuaacaucaaagaucacagcguugugucuuccuaugucuguagcggccuggugggcgacaccccgcggaagaaugacucuagcuccucuagccauugccuugauccuaacaaugaggaagggggacacggcguuaaagggugggccuucgacgauggaaacgacguguggaugggccgcacgauuaaugagacauccagacugggguacgagaccuuuaaggucaucgaaggauggagcaaccccaaaucuaagcuccagaucaaucgccaggugauugucgaucggggcgacagauccggcuauagcgggaucuucucuguggagggaaaauccuguauuaaccggugcuuuuacguugaacugaucagaggccgcaaggaggaaaccgaggugcuguggacaagcaauuccauugucguguucugugggaccucuggaacauauggcacggggagcuggccugauggcgcugaccucaaccugaugcccaucuga

SEQ ID NO: 208377 - RNA, 1410 nt, Artificial Sequence; identical to SEQ ID NO: 205170
  derived and/or modified sequence opt5 from neuraminidase__InfluenzaA__AHZ40324

SEQ ID NO: 208378 - RNA, 1410 nt, Artificial Sequence; identical to SEQ ID NO: 205170
  derived and/or modified sequence opt5 from neuraminidase__InfluenzaA__AHZ40336

SEQ ID NO: 208379 - RNA, 1410 nt, Artificial Sequence; identical to SEQ ID NO: 208353
  derived and/or modified sequence opt5 from neuraminidase__InfluenzaA__AHZ40348

SEQ ID NO: 208380 - RNA, 1410 nt, Artificial Sequence; identical to SEQ ID NO: 206378
  derived and/or modified sequence opt5 from neuraminidase__InfluenzaA__AHZ40360

SEQ ID NO: 208381 - RNA, 1410 nt, Artificial Sequence
  derived and/or modified sequence opt5 from neuraminidase__InfluenzaA__AHZ40372
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaaggggaccacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggacauccaauucuaucguggucuucuguggcaccagcgggacauacggaacgggcuccuggccugacggggcugaucucaaccugaugcccauuuga

SEQ ID NO: 208382 - RNA, 1410 nt, Artificial Sequence; identical to SEQ ID NO: 206034
  derived and/or modified sequence opt5 from neuraminidase__InfluenzaA__AHZ40384

SEQ ID NO: 208383 - RNA, 1410 nt, Artificial Sequence; identical to SEQ ID NO: 205170
  derived and/or modified sequence opt5 from neuraminidase__InfluenzaA__AHZ40396

SEQ ID NO: 208384 - RNA, 1410 nt, Artificial Sequence; identical to SEQ ID NO: 205170
  derived and/or modified sequence opt5 from neuraminidase__InfluenzaA__AHZ40408

SEQ ID NO: 208385 - RNA, 1410 nt, Artificial Sequence; identical to SEQ ID NO: 205170
  derived and/or modified sequence opt5 from neuraminidase__InfluenzaA__AHZ40420

SEQ ID NO: 208386 - RNA, 1410 nt, Artificial Sequence
  derived and/or modified sequence opt5 from neuraminidase__InfluenzaA__AHZ40432
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucauugauaucaacauuaaagaccacucuaucgugucccgguacguuuguagcggacuggugggcgacaccccgcgcaagaaugauucuagcuccucuagccauugccuugacccuaacaaugaggaaggcgggcacggagucaaaggcugggccuucgaugacgggaacgauguguggaugggaagaacgaucaaugagacaucccggcugggcuaugagaccuuuaagguuauugaaggguggagcaaccccaaaucuaagcuccagaucaaucgccaggugauugucgacagaggagaucgguccggcuacagcggcaucuucucuguggaggggaaauccuguauuaacagaugcuuuuaugucgaacugauccgcggacggaaggaggaaaccgaggugcuguggacaagcaauuccauuguuguguucuguggcaccucugggacauacggaacgggcagcuggccugacggggcugaucucaaccugaugcccaucuga

SEQ ID NO: 208387 - RNA, 1410 nt, Artificial Sequence; identical to SEQ ID NO: 205170
  derived and/or modified sequence opt5 from neuraminidase__InfluenzaA__AHZ40444

SEQ ID NO: 208388 - RNA, 1410 nt, Artificial Sequence
  derived and/or modified sequence opt5 from neuraminidase__InfluenzaA__AHZ40456
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacaugcauagcaauaacaccgugcgggaucgcacgcccuauagaacacugcucaugaaugaacugggcguuccuuuucaccuggggaccaaacaggugugcauugccugguccucuagcuccugucaugacggaaaggccuggcuccacgucugcaucacaggcgaugacaagaacgcuaccgccagcuucauuuacaauggccggcugguggauucuguuguguccuggagcaaagagauccuucgcacccaggaaucugagugugucugcauuaacgggacauguacgguggugaugaccgacggauccgcuagcggcaaggccgauacaaaaauccuguuuaucgaggaagggaagauuguccauaccuccacacucucuggaagcgcgcaacacguugaggaaugcuccugcuaucccagauacccuggcgugcggugugugugccgcgacaacuggaaggggagcaauagacccaucgucgauauuaacaucaaagaccacucuauuguguccagcuacguuuguucuggacuggugggcgacaccccgcggaagaaugauagcuccucuagcucccauugccuugacccuaacaaugaggaaggcgggcacggagucaaaggcugggccuucgaugacgggaacgauguguggaugggacgcacgaucaaugagacaagcagacugggcuaugagaccuuuaagguuaucgaaggguggucuaaccccaaauccaagcuccagauuaaucgccaggugaucgucgaccggggagauagaagcggcuacucuggcauuuucuccguggaggggaaaagcuguaucaaccggugcuuuuaugucgaacugauuagaggacgcaaggaggaaaccgaggugcuguggacauccaauucuaucguuguguucuguggcaccagcgggacauacggaacgggcuccuggccugacggggcugaucucaaccugaugcccauuuga

SEQ ID NO: 208389 - RNA, 1410 nt, Artificial Sequence
  derived and/or modified sequence opt5 from neuraminidase__InfluenzaA__AHZ40468
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcaacgacaagaaugcuaccgccagcuucauuuacaacgggcggcugguugauucuguggucuccuggagcaaagagauccuucgcacccaggaaucugagugugugugcauuaacggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaauuggaagggaagcaacagacccaucguggauauuaauaucaaagaccacucuauuguuuccagcuacguguguucuggccuggucggcgauaccccgcggaagaacgacagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 208390 - RNA, 1410 nt, Artificial Sequence; identical to SEQ ID NO: 206378
  derived and/or modified sequence opt5 from neuraminidase__InfluenzaA__AHZ40480

SEQ ID NO: 208391 - RNA, 1410 nt, Artificial Sequence; identical to SEQ ID NO: 207816
  derived and/or modified sequence opt5 from neuraminidase__InfluenzaA__AHZ40492

SEQ ID NO: 208392 - RNA, 1410 nt, Artificial Sequence; identical to SEQ ID NO: 205170
  derived and/or modified sequence opt5 from neuraminidase__InfluenzaA__AHZ40503

SEQ ID NO: 208393 - RNA, 1410 nt, Artificial Sequence; identical to SEQ ID NO: 205170
  derived and/or modified sequence opt5 from neuraminidase__InfluenzaA__AHZ40515

SEQ ID NO: 208394 - RNA, 1410 nt, Artificial Sequence
  derived and/or modified sequence opt5 from neuraminidase__InfluenzaA__AHZ40527
augaaccccaaucagaagaucauuaccaucggcagcgugucccugacaauuucuacgaugugcuucuuuaugcaaaucgccauucucaucaccacagucacccugcacuucaaacaguacgaguuugacagcccuccgaacaaucagguuaugcuuugugaacccacaaucauugagagaaacaucaccgaaauuguguaucugacaaauaccacgaucgagaaggaaauuugcccuaaacccgcugaguaccggaacugguccaagccucagugugggaucaccggauucgcccccuuuucuaaagauaauagcauucgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcaucgccugguccucuagcuccugucaugacggcaaagccuggcuccacgugugcauuacaggcgaugacaagaaugcuaccgccagcuucaucuacaacgggcggcugguugauucuguggucuccuggagcaaagagauucuucgcacccaggaaucugagugugugugcaucaauggaacauguacgguggucaugaccgacggcuccgcuagcgggaaggccgauacaaaaauucuguuuaucgaggaaggaaagaucguucauaccuccacacucucuggcagcgcgcaacacguggaggaaugcuccugcuaucccagauacccuggggugcggugugucugccgcgacaacuggaagggaagcaacagacccauuguggauaucaauauuaaagaccacucuaucguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgauuaacgagacaagcagacugggguaugagaccuuuaaggugaucgaaggauggucuaaucccaaauccaagcuccagaucaaccggcaggucauuguggaccgcggcgauagaagcggcuacucugggaucuucuccgucgagggaaaaagcuguauuaaucggugcuuuuauguggaacugaucagaggccgcaaggaggaaaccgagguucuguggacauccaacucuauuguggucuucugugggaccagcggaacauacggcacgggguccuggccugacggcgcugaucucaaucugaugcccaucuga

SEQ ID NO: 208395 - RNA, 1410 nt, Artificial Sequence
  derived and/or modified sequence opt5 from neuraminidase__InfluenzaA__AHZ40539
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguuaacaccuccacacucucuggcagcgcgcaacauguggaggaaugcuccugcuaucccagauacccuggggugcggugugucugccgcgauaauuggaagggaagcaacagacccaucguggacauuaauaucaaagaucacucuauuguuuccagcuacguguguucuggccuggucggcgacaccccgcggaagaacgacagcuccucuagcucccacugccuugauccuaauaacgaggaagggggacauggcgugaaagggugggccuucgacgauggaaaugacguuuggaugggccgcacgaucaacgagacaagcagacugggguaugagaccuuuaaggugaucgaaggauggucuaaucccaaauccaagcuccagauuaaccggcaggucaucguggaucgcggcgacagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugauggcgcugaccucaaucugaugcccauuuga

SEQ ID NO: 208396 - RNA, 1410 nt, Artificial Sequence; identical to SEQ ID NO: 205170
  derived and/or modified sequence opt5 from neuraminidase__InfluenzaA__AHZ40551

SEQ ID NO: 208397 - RNA, 1410 nt, Artificial Sequence
  derived and/or modified sequence opt5 from neuraminidase__InfluenzaA__AHZ40563
augaaccccaaucagaagaucauuaccaucggcagcgugucccugacaauuucuacggucugcuucuuuaugcaaaucgccauucucaucaccacaguuacccugcacuucaaacaguacgaguuuaacagcuccccuaauaaccaggugaugcuuugugaaccgacaaucauugagagaaauaucaccgaaauuguguaucugacaaacaccacgaucgagaaggaaauuugccccaaaccugcugaguaccggaauuggucuaagccccagugugggaucaccggauucgccccuuuuagcaaagacaacuccauucgccucucugcgggcggggauaucugggucacaagagagcccuaugugagcugcgacccugauaaguguuaccaauucgcucugggacagggcaccacacuuaauaacguucauuccaauaacaccgugcgggaccgcacgccguauagaacacugcucaugaaugaacuggggguccccuuucaccugggaaccaaacaggugugcaucgccuggucuagcuccagcugucaugauggcaaggccuggcuccacguuugcauuacaggcgacgauaagaacgcuaccgccucuuucaucuacaaugggcggcugguggacuccgucgugagcuggucuaaagagauucuucgcacccaggaauccgagugugugugcaucaacggaacauguacggucguuaugaccgauggcagcgcuuccgggaaggccgacacaaaaauucuguuuaucgaggaaggaaagaucgugcauaccucuacacucagcggcuccgcgcaacacguggaggaaugcagcugcuauccuagauaccccgggguccggugugugugccgcgauaacuggaagggaucuaauagaccuauuguugacaucaacauuaaagaucacuccaucgugagcucuuacgucuguagcggccuggugggcgacacgccccggaagaaugacuccucuagcuccagccauugccuugauccgaacaaugaggaagggggacacggcguuaaagggugggccuucgacgauggaaacgacguguggaugggccgcaccauuaaugagacaucuagacugggguaugagaccuuuaaggucaucgaaggaugguccaacagcaaaucuaagcuccagaucaaucgccaggugauugucgaucggggcgacagauccggcuacagcgggaucuucuccguggagggaaaaucuuguauuaaccggugcuuuuauguugaacugaucagaggccgcaaggaggaaaccgaggugcuguggacaagcaauuccauugucguguucugugggaccucuggaacauacggcacggggagcuggccugauggcgcugaccucaaccugaugcccaucuga

SEQ ID NO: 208398 - RNA, 1410 nt, Artificial Sequence
  derived and/or modified sequence opt5 from neuraminidase__InfluenzaA__AHZ40575
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuagccggcaggucaucguggaucgcggcgacagaucuggcuacuccgggauuuucagcgucgagggaaaauccuguaucaaucggugcuuuuauguggaacugauuagaggccgcaaggaggaaaccgagguucuguggacaucuaacagcaucguggucuucugugggaccuccggaacauacggcacggggucuuggccugauggcgcugaccucaaucugaugcccauuuga

SEQ ID NO: 208399 - RNA, 1410 nt, Artificial Sequence; identical to SEQ ID NO: 208117
  derived and/or modified sequence opt5 from neuraminidase__InfluenzaA__AHZ40586

SEQ ID NO: 208400 - RNA, 1410 nt, Artificial Sequence
  derived and/or modified sequence opt5 from neuraminidase__InfluenzaA__AHZ40598
augaaccccaaucagaagaucauuaccaucggcagcgugugcaugacaauugggauggccaaccugauccuccaaauuggaaauaucaucuccauuuggaucucucacagcauucaggucggcaaccagucccagaucgagacguguaaucaaucuguuauuaccuacgaaaacaauacaugggugaaccagaccuaugugaauaucagcaacacaaauuucgcugccgggcagccugucguguccguuaaacuggcgggaaacucuagccuuugcccgguguccggcugggcuauuuacagcaaggacaauucugucagaaucggguccaaaggagauguguuuguuauccgggagcccuucauuagcuguucuccucuggaaugccgcaccuuuuuccucacacagggcgcccugcuuaacgacaagcauuccaauggcaccaucaaagauagaagccccuaucggacgcugaugucuuguccuauuggggaggugcccuccccuuacaacagccgcuuugaauccgucgccuggucugcuagcgccugccacgacggaaucaacuggcucaccauuggcaucuccgggccggauagcggagcuguggccgugcugaaguauaauggcaucauuacagacaccaucaagucuuggagaaacgauauucugcggacacaagaguccgagugugcgugcgucaaugggagcuguuucaccaucaugacggacggacccucugauggccaggccagcuacaaaauuuuucgcaucgaaaagggcaaaaucguuaaguccguggagaugaacgcuccuaauuaucauuacgaagagugcucuuguuaccccgacagcuccgagauuacaugcgugugcagagauaacuggcacgggagcaaucggccuugggucucuuucaaccagaaucucgaauaucagaucggauacauuuguuccggcaucuuuggggacaacccccgcccgaaugauaaaaccggaagcugcggcccugugucuuccaacggggccaauggaguuaagggcuucagcuuuaaguauggcaacgggguguggauuggaagaacaaaauccaucucuagccggaagggcuucgagaugauuugggaccccaauggguggaccggaaccgacaacaacuuuuccaucaaacaagauaucgucggcauuaaugaauggucuggguacagcggcuccuucgugcagcauccugagcugacaggacuugacuguauccgccccugcuucuggguugaacugauuagaggccggcccaaggagaacacgaucuggaccagcgggucuuccauuagcuuuuguggagucaauucugauacagugggcugguccuggccugacggggcugagcucccguucaccaucgauaaauga

SEQ ID NO: 208401 - RNA, 1410 nt, Artificial Sequence; identical to SEQ ID NO: 205170
  derived and/or modified sequence opt5 from neuraminidase__InfluenzaA__AHZ40609

SEQ ID NO: 208402 - RNA, 1410 nt, Artificial Sequence; identical to SEQ ID NO: 206399
  derived and/or modified sequence opt5 from neuraminidase__InfluenzaA__AHZ40629

SEQ ID NO: 208403 - RNA, 1410 nt, Artificial Sequence; identical to SEQ ID NO: 206381
  derived and/or modified sequence opt5 from neuraminidase__InfluenzaA__AHZ40641

SEQ ID NO: 208404 - RNA, 1410 nt, Artificial Sequence
  derived and/or modified sequence opt5 from neuraminidase__InfluenzaA__AHZ40653
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcuggguaccggaauugguccaagccucaguguggaauuaccggcuucgcccccuuuucuaaagacaacagcauccgccucuccgcugggggagauaucugggugacaagagagccuuaugucucuugcgacccggauaaguguuaccaauucgcgcugggccaggggaccacacuuaauaacgugcauagcaauaacaccguucgggaccgcacgcccuauagaacacugcucaugaaugagcugggagugccuuuucaccugggcaccaagcaggucugcauugccugguccucuagcuccugucaugauggcaaagccuggcuccacgugugcaucacaggggacgauaagaacgcuaccgccagcuucauuuacaauggacggcugguugacucuguggucuccuggagcaaagaaauccuucgcacccaggagucugaaugugugugcauuaacggcacauguacgguggucaugaccgauggguccgcuagcggaaaggccgacacaaaaauccuguuuaucgaggagggcaagauuguucauaccuccacacucucugggagcgcgcaacacguggaagagugcuccugcuaucccagauacccuggagugcggugugucugccgcgauaacuggaagggcagcaauagacccaucguggacauuaacaucaaagaucacucuauuguuuccagcuacguguguucuggccuggucggggacaccccgcggaagaaugacagcuccucuagcucccauugccuugauccuaacaaugaagagggaggccacggggugaaaggaugggccuucgacgauggcaacgacguuuggauggggcgcacgaucaaugaaacaagcagacugggauaugagaccuuuaaggugaucgagggcuggucuaaccccaaauccaagcuccagauuaaucggcaggucaucguggaucgcggcgacagaagcggguacucuggaauuuucuccgucgaaggcaaaagcuguaucaaccggugcuuuuauguggagcugauuagagggcgcaaggaagagaccgaaguucuguggacauccaauucuaucguggucuucuguggaaccagcggcacauacgggacgggcuccuggccugauggagcugaccucaaccugaugcccauuuga

SEQ ID NO: 208405 - RNA, 1410 nt, Artificial Sequence; identical to SEQ ID NO: 206399
  derived and/or modified sequence opt5 from neuraminidase__InfluenzaA__AHZ40665

SEQ ID NO: 208406 - RNA, 1410 nt, Artificial Sequence; identical to SEQ ID NO: 206399
  derived and/or modified sequence opt5 from neuraminidase__InfluenzaA__AHZ40677

SEQ ID NO: 208407 - RNA, 1410 nt, Artificial Sequence; identical to SEQ ID NO: 205170
  derived and/or modified sequence opt5 from neuraminidase__InfluenzaA__AHZ40689

SEQ ID NO: 208408 - RNA, 1410 nt, Artificial Sequence
  derived and/or modified sequence opt5 from neuraminidase__InfluenzaA__AHZ40713
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacaaaagcggcuacucugggauuuucuccgucgagggaaagagcuguaucaacagaugcuuuuauguggaacugauucggggcagaaaggaggaaaccgagguucuguggacauccaauucuaucguggucuucugugggaccagcggaacauacggcacgggguccuggccugauggcgcugaccucaaccugaugcccauuuga

SEQ ID NO: 208409 - RNA, 1410 nt, Artificial Sequence
  derived and/or modified sequence opt5 from neuraminidase__InfluenzaA__AHZ40725
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccggcuacguguguagcggccuggucggggacaccccgcggaagaaugacucuagcuccucuagccauugccuugauccuaacaaugaggaaggaggccacggggugaaaggaugggccuucgacgauggcaacgacguuuggauggggcgcacgaucaaugagacauccagacugggauaugagaccuuuaaggugaucgaaggcuggagcaaccccaaaucuaagcuccagauuaaucggcaggucaucguggaucgcggcgacagauccggguacagcggaauuuucucugucgagggcaaauccuguaucaaccggugcuuuuauguggaacugauuagagggcgcaaggaggaaaccgagguucuguggacaagcaauuccaucguggucuucuguggaaccucuggcacauacgggacgggcagcuggccugauggagcugaccucaaccugaugcccauuuga

SEQ ID NO: 208410 - RNA, 1410 nt, Artificial Sequence; identical to SEQ ID NO: 206388
  derived and/or modified sequence opt5 from neuraminidase__InfluenzaA__AHZ40737

SEQ ID NO: 208411 - RNA, 1410 nt, Artificial Sequence
  derived and/or modified sequence opt5 from neuraminidase__InfluenzaA__AHZ40749
augaaccccaaucagaagaucauuaccaucggcagcgugucccugacaauuucuacgaucugccucuucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacccgcugaguaccggaauugguccaagccucagugugggauuaccggauuugcccccuucucuaaagacaacagcauccgccuguccgcgggcggggauaucugggugacaagagagccuuaugucucuugcgacccggauaaguguuaccaauuugcucuuggacagggcaccacacugaauaacgugcauagcaauaacaccguucgggaccgcacgcccuauagaacacuccugaugaaugaacugggggugccuuuccaccucggaaccaagcaggucugcauugccugguccuccucuuccugucaugauggcaaagccuggcugcacgugugcaucacaggcgacgauaagaacgcuaccgccagcuuuauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuucaucgaggaaggaaagauuguucauaccuccacacugucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuugucggcgacaccccgcggaagaaugacagcuccucuagcucccauugccuggauccuaacaaugaggaagggggacacggcgugaaagggugggccuuugacgauggaaacgacguuuggaugggccgcacgaucaaugagacaagcagacucggguaugagaccuucaaggugaucgaaggauggucuaaccccaaauccaagcugcagauuaaucggcaggucaucguggaucgcggcgacagaagcggcuacucugggauuuuuagcgucgagggaaaaagcuguaucaaccggugcuucuauguggaacugauuagaggccgcaaggaggaaaccgagguucucuggacauccaauucuaucguggucuuuugugggaccagcggaacauacggcacggggccuuggcccgauggcgcugaccugaaccuuaugcccauuuga

SEQ ID NO: 208412 - RNA, 1410 nt, Artificial Sequence
  derived and/or modified sequence opt5 from neuraminidase__InfluenzaA__AHZ40761
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaacucugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcauggccugguccagcagcuccugucaugacggaaaagccuggcuucacgugugcaucacaggcgaugacaagaacgcuaccgccagcuucauuuacaauggcaaacugguugauucuguggucuccuggagcaaggagauccuccggacccaggaaucugagugugugugcauuaacgggacauguacgguggucaugaccgacggauccgcuagcggcaaagccgauacaaagauccuguuuauugaggaagggaagaucguucauaccuccacacuuucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuggucggcgacacccccagaaaaacggauagcuccucuagcucccauugccucgacccgaauaacgaggaaggcgggcacggagugaagggcugggccuucgaugacgggaaugauguuuggaugggacggacaaucaacgagaccagccgccugggcuaugagaccuuuaaagugauugaaggguggucuaauccuaaguccaaacugcagaucaacagacaggucaucguggaccggggagaucgcagcggcuacucuggcauuuucuccgucgaggggaagucuuguaucaauagaugcuuuuauguggaacucauucggggaagaaagaaagagacagcuguucuguggaccuccaacucuaucguggucuucuguggcacaagcgggacguacggaaccggcuccuggcccgacggggccgaucuuaaucugaugccuauuuga

SEQ ID NO: 208413 - RNA, 1410 nt, Artificial Sequence; identical to SEQ ID NO: 205170
  derived and/or modified sequence opt5 from neuraminidase__InfluenzaA__AHZ40773

SEQ ID NO: 208414 - RNA, 1410 nt, Artificial Sequence; identical to SEQ ID NO: 199752
  derived and/or modified sequence opt5 from neuraminidase__InfluenzaA__AHZ40785

SEQ ID NO: 208415 - RNA, 1410 nt, Artificial Sequence; identical to SEQ ID NO: 199752
  derived and/or modified sequence opt5 from neuraminidase__InfluenzaA__AHZ40796

SEQ ID NO: 208416 - RNA, 1410 nt, Artificial Sequence; identical to SEQ ID NO: 199752
  derived and/or modified sequence opt5 from neuraminidase__InfluenzaA__AHZ40807

SEQ ID NO: 208417 - RNA, 1410 nt, Artificial Sequence; identical to SEQ ID NO: 199752
  derived and/or modified sequence opt5 from neuraminidase__InfluenzaA__AHZ40818

SEQ ID NO: 208418 - RNA, 1410 nt, Artificial Sequence; identical to SEQ ID NO: 199752
  derived and/or modified sequence opt5 from neuraminidase__InfluenzaA__AHZ40829

SEQ ID NO: 208419 - RNA, 1410 nt, Artificial Sequence; identical to SEQ ID NO: 199752
  derived and/or modified sequence opt5 from neuraminidase__InfluenzaA__AHZ40840

SEQ ID NO: 208420 - RNA, 1410 nt, Artificial Sequence; identical to SEQ ID NO: 199752
  derived and/or modified sequence opt5 from neuraminidase__InfluenzaA__AHZ40851

SEQ ID NO: 208421 - RNA, 1410 nt, Artificial Sequence; identical to SEQ ID NO: 199752
  derived and/or modified sequence opt5 from neuraminidase__InfluenzaA__AHZ40862

SEQ ID NO: 208422 - RNA, 1410 nt, Artificial Sequence; identical to SEQ ID NO: 199752
  derived and/or modified sequence opt5 from neuraminidase__InfluenzaA__AHZ40873

SEQ ID NO: 208423 - RNA, 1410 nt, Artificial Sequence; identical to SEQ ID NO: 199752
  derived and/or modified sequence opt5 from neuraminidase__InfluenzaA__AHZ40884

SEQ ID NO: 208424 - RNA, 1410 nt, Artificial Sequence; identical to SEQ ID NO: 199752
  derived and/or modified sequence opt5 from neuraminidase__InfluenzaA__AHZ40895

SEQ ID NO: 208425 - RNA, 1410 nt, Artificial Sequence; identical to SEQ ID NO: 199752
  derived and/or modified sequence opt5 from neuraminidase__InfluenzaA__AHZ40906

SEQ ID NO: 208426 - RNA, 1410 nt, Artificial Sequence; identical to SEQ ID NO: 199752
  derived and/or modified sequence opt5 from neuraminidase__InfluenzaA__AHZ40917

SEQ ID NO: 208427 - RNA, 1410 nt, Artificial Sequence; identical to SEQ ID NO: 199752
  derived and/or modified sequence opt5 from neuraminidase__InfluenzaA__AHZ40928

SEQ ID NO: 208428 - RNA, 1410 nt, Artificial Sequence; identical to SEQ ID NO: 199752
  derived and/or modified sequence opt5 from neuraminidase__InfluenzaA__AHZ40939

SEQ ID NO: 208429 - RNA, 1410 nt, Artificial Sequence; identical to SEQ ID NO: 199752
  derived and/or modified sequence opt5 from neuraminidase__InfluenzaA__AHZ40950

SEQ ID NO: 208430 - RNA, 1410 nt, Artificial Sequence; identical to SEQ ID NO: 199752
  derived and/or modified sequence opt5 from neuraminidase__InfluenzaA__AHZ40961

SEQ ID NO: 208431 - RNA, 1410 nt, Artificial Sequence; identical to SEQ ID NO: 199752
  derived and/or modified sequence opt5 from neuraminidase__InfluenzaA__AHZ40972

SEQ ID NO: 208432 - RNA, 1410 nt, Artificial Sequence; identical to SEQ ID NO: 199752
  derived and/or modified sequence opt5 from neuraminidase__InfluenzaA__AHZ40983

SEQ ID NO: 208433 - RNA, 1410 nt, Artificial Sequence; identical to SEQ ID NO: 199752
  derived and/or modified sequence opt5 from neuraminidase__InfluenzaA__AHZ40994

SEQ ID NO: 208434 - RNA, 1410 nt, Artificial Sequence; identical to SEQ ID NO: 199752
  derived and/or modified sequence opt5 from neuraminidase__InfluenzaA__AHZ41005

SEQ ID NO: 208435 - RNA, 1410 nt, Artificial Sequence; identical to SEQ ID NO: 199752
  derived and/or modified sequence opt5 from neuraminidase__InfluenzaA__AHZ41016

SEQ ID NO: 208436 - RNA, 1410 nt, Artificial Sequence; identical to SEQ ID NO: 199752
  derived and/or modified sequence opt5 from neuraminidase__InfluenzaA__AHZ41027

SEQ ID NO: 208437 - RNA, 1410 nt, Artificial Sequence; identical to SEQ ID NO: 199752
  derived and/or modified sequence opt5 from neuraminidase__InfluenzaA__AHZ41049

SEQ ID NO: 208438 - RNA, 1410 nt, Artificial Sequence; identical to SEQ ID NO: 199752
  derived and/or modified sequence opt5 from neuraminidase__InfluenzaA__AHZ41060

SEQ ID NO: 208439 - RNA, 1410 nt, Artificial Sequence; identical to SEQ ID NO: 199752
  derived and/or modified sequence opt5 from neuraminidase__InfluenzaA__AHZ41071

SEQ ID NO: 208440 - RNA, 1410 nt, Artificial Sequence; identical to SEQ ID NO: 199752
  derived and/or modified sequence opt5 from neuraminidase__InfluenzaA__AHZ41082

SEQ ID NO: 208441 - RNA, 1410 nt, Artificial Sequence; identical to SEQ ID NO: 199752
  derived and/or modified sequence opt5 from neuraminidase__InfluenzaA__AHZ41093

SEQ ID NO: 208442 - RNA, 1410 nt, Artificial Sequence; identical to SEQ ID NO: 199752
  derived and/or modified sequence opt5 from neuraminidase__InfluenzaA__AHZ41104

SEQ ID NO: 208443 - RNA, 1410 nt, Artificial Sequence; identical to SEQ ID NO: 199752
  derived and/or modified sequence opt5 from neuraminidase__InfluenzaA__AHZ41115

SEQ ID NO: 208444 - RNA, 1410 nt, Artificial Sequence; identical to SEQ ID NO: 199752
  derived and/or modified sequence opt5 from neuraminidase__InfluenzaA__AHZ41126

SEQ ID NO: 208445 - RNA, 1410 nt, Artificial Sequence; identical to SEQ ID NO: 199752
  derived and/or modified sequence opt5 from neuraminidase__InfluenzaA__AHZ41137

SEQ ID NO: 208446 - RNA, 1410 nt, Artificial Sequence; identical to SEQ ID NO: 199752
  derived and/or modified sequence opt5 from neuraminidase__InfluenzaA__AHZ41148

SEQ ID NO: 208447 - RNA, 1410 nt, Artificial Sequence; identical to SEQ ID NO: 199752
  derived and/or modified sequence opt5 from neuraminidase__InfluenzaA__AHZ41159

SEQ ID NO: 208448 - RNA, 1410 nt, Artificial Sequence; identical to SEQ ID NO: 199752
  derived and/or modified sequence opt5 from neuraminidase__InfluenzaA__AHZ41170

SEQ ID NO: 208449 - RNA, 1410 nt, Artificial Sequence; identical to SEQ ID NO: 199752
  derived and/or modified sequence opt5 from neuraminidase__InfluenzaA__AHZ41181

SEQ ID NO: 208450 - RNA, 1410 nt, Artificial Sequence; identical to SEQ ID NO: 199752
  derived and/or modified sequence opt5 from neuraminidase__InfluenzaA__AHZ41205

SEQ ID NO: 208451 - RNA, 1410 nt, Artificial Sequence; identical to SEQ ID NO: 199752
  derived and/or modified sequence opt5 from neuraminidase__InfluenzaA__AHZ41251

SEQ ID NO: 208452 - RNA, 1410 nt, Artificial Sequence; identical to SEQ ID NO: 199752
  derived and/or modified sequence opt5 from neuraminidase__InfluenzaA__AHZ41266

SEQ ID NO: 208453 - RNA, 1410 nt, Artificial Sequence; identical to SEQ ID NO: 199752
  derived and/or modified sequence opt5 from neuraminidase__InfluenzaA__AHZ41284

SEQ ID NO: 208454 - RNA, 1410 nt, Artificial Sequence; identical to SEQ ID NO: 199752
  derived and/or modified sequence opt5 from neuraminidase__InfluenzaA__AHZ41295

SEQ ID NO: 208455 - RNA, 1410 nt, Artificial Sequence; identical to SEQ ID NO: 199752
  derived and/or modified sequence opt5 from neuraminidase__InfluenzaA__AHZ41306

SEQ ID NO: 208456 - RNA, 1410 nt, Artificial Sequence; identical to SEQ ID NO: 199752
  derived and/or modified sequence opt5 from neuraminidase__InfluenzaA__AHZ41317

SEQ ID NO: 208457 - RNA, 1410 nt, Artificial Sequence; identical to SEQ ID NO: 199752
  derived and/or modified sequence opt5 from neuraminidase__InfluenzaA__AHZ41328

SEQ ID NO: 208458 - RNA, 1410 nt, Artificial Sequence; identical to SEQ ID NO: 199752
  derived and/or modified sequence opt5 from neuraminidase__InfluenzaA__AHZ41339

SEQ ID NO: 208459 - RNA, 1410 nt, Artificial Sequence; identical to SEQ ID NO: 199752
  derived and/or modified sequence opt5 from neuraminidase__InfluenzaA__AHZ41350

SEQ ID NO: 208460 - RNA, 1410 nt, Artificial Sequence; identical to SEQ ID NO: 199752
  derived and/or modified sequence opt5 from neuraminidase__InfluenzaA__AHZ41369

SEQ ID NO: 208461 - RNA, 1410 nt, Artificial Sequence; identical to SEQ ID NO: 199752
  derived and/or modified sequence opt5 from neuraminidase__InfluenzaA__AHZ41380

SEQ ID NO: 208462 - RNA, 1410 nt, Artificial Sequence; identical to SEQ ID NO: 199752
  derived and/or modified sequence opt5 from neuraminidase__InfluenzaA__AHZ41391

SEQ ID NO: 208463 - RNA, 1410 nt, Artificial Sequence; identical to SEQ ID NO: 199752
  derived and/or modified sequence opt5 from neuraminidase__InfluenzaA__AHZ41402

SEQ ID NO: 208464 - RNA, 1410 nt, Artificial Sequence; identical to SEQ ID NO: 199752
  derived and/or modified sequence opt5 from neuraminidase__InfluenzaA__AHZ41413

SEQ ID NO: 208465 - RNA, 1410 nt, Artificial Sequence; identical to SEQ ID NO: 199752
  derived and/or modified sequence opt5 from neuraminidase__InfluenzaA__AHZ41444

SEQ ID NO: 208466 - RNA, 1410 nt, Artificial Sequence; identical to SEQ ID NO: 199752
  derived and/or modified sequence opt5 from neuraminidase__InfluenzaA__AHZ41455

SEQ ID NO: 208467 - RNA, 1410 nt, Artificial Sequence; identical to SEQ ID NO: 199752
  derived and/or modified sequence opt5 from neuraminidase__InfluenzaA__AHZ41476

SEQ ID NO: 208468 - RNA, 1410 nt, Artificial Sequence; identical to SEQ ID NO: 199752
  derived and/or modified sequence opt5 from neuraminidase__InfluenzaA__AHZ41487

SEQ ID NO: 208469 - RNA, 1410 nt, Artificial Sequence; identical to SEQ ID NO: 199752
  derived and/or modified sequence opt5 from neuraminidase__InfluenzaA__AHZ41498

SEQ ID NO: 208470 - RNA, 1410 nt, Artificial Sequence; identical to SEQ ID NO: 199752
  derived and/or modified sequence opt5 from neuraminidase__InfluenzaA__AHZ41509

SEQ ID NO: 208471 - RNA, 1410 nt, Artificial Sequence; identical to SEQ ID NO: 199752
  derived and/or modified sequence opt5 from neuraminidase__InfluenzaA__AHZ41520

SEQ ID NO: 208472 - RNA, 1410 nt, Artificial Sequence; identical to SEQ ID NO: 199752
  derived and/or modified sequence opt5 from neuraminidase__InfluenzaA__AHZ41531

SEQ ID NO: 208473 - RNA, 1410 nt, Artificial Sequence; identical to SEQ ID NO: 199752
  derived and/or modified sequence opt5 from neuraminidase__InfluenzaA__AHZ41542

SEQ ID NO: 208474 - RNA, 1410 nt, Artificial Sequence; identical to SEQ ID NO: 199752
  derived and/or modified sequence opt5 from neuraminidase__InfluenzaA__AHZ41553

SEQ ID NO: 208475 - RNA, 1410 nt, Artificial Sequence; identical to SEQ ID NO: 199752
  derived and/or modified sequence opt5 from neuraminidase__InfluenzaA__AHZ41564

SEQ ID NO: 208476 - RNA, 1410 nt, Artificial Sequence; identical to SEQ ID NO: 199752
  derived and/or modified sequence opt5 from neuraminidase__InfluenzaA__AHZ41586

SEQ ID NO: 208477 - RNA, 1410 nt, Artificial Sequence; identical to SEQ ID NO: 199752
  derived and/or modified sequence opt5 from neuraminidase__InfluenzaA__AHZ41597

SEQ ID NO: 208478 - RNA, 1410 nt, Artificial Sequence; identical to SEQ ID NO: 199752
  derived and/or modified sequence opt5 from neuraminidase__InfluenzaA__AHZ41608

SEQ ID NO: 208479 - RNA, 1410 nt, Artificial Sequence; identical to SEQ ID NO: 199752
  derived and/or modified sequence opt5 from neuraminidase__InfluenzaA__AHZ41619

SEQ ID NO: 208480 - RNA, 1410 nt, Artificial Sequence; identical to SEQ ID NO: 199752
  derived and/or modified sequence opt5 from neuraminidase__InfluenzaA__AHZ41630

SEQ ID NO: 208481 - RNA, 1410 nt, Artificial Sequence; identical to SEQ ID NO: 199752
  derived and/or modified sequence opt5 from neuraminidase__InfluenzaA__AHZ41641

SEQ ID NO: 208482 - RNA, 1410 nt, Artificial Sequence; identical to SEQ ID NO: 199752
  derived and/or modified sequence opt5 from neuraminidase__InfluenzaA__AHZ41652

SEQ ID NO: 208483 - RNA, 1410 nt, Artificial Sequence; identical to SEQ ID NO: 199752
  derived and/or modified sequence opt5 from neuraminidase__InfluenzaA__AHZ41663

SEQ ID NO: 208484 - RNA, 1410 nt, Artificial Sequence; identical to SEQ ID NO: 199752
  derived and/or modified sequence opt5 from neuraminidase__InfluenzaA__AHZ41674

SEQ ID NO: 208485 - RNA, 1410 nt, Artificial Sequence; identical to SEQ ID NO: 199752
  derived and/or modified sequence opt5 from neuraminidase__InfluenzaA__AHZ41685

SEQ ID NO: 208486 - RNA, 1410 nt, Artificial Sequence; identical to SEQ ID NO: 199752
  derived and/or modified sequence opt5 from neuraminidase__InfluenzaA__AHZ41696

SEQ ID NO: 208487 - RNA, 1410 nt, Artificial Sequence; identical to SEQ ID NO: 199752
  derived and/or modified sequence opt5 from neuraminidase__InfluenzaA__AHZ41707

SEQ ID NO: 208488 - RNA, 1410 nt, Artificial Sequence; identical to SEQ ID NO: 199752
  derived and/or modified sequence opt5 from neuraminidase__InfluenzaA__AHZ41718

SEQ ID NO: 208489 - RNA, 1410 nt, Artificial Sequence; identical to SEQ ID NO: 199752
  derived and/or modified sequence opt5 from neuraminidase__InfluenzaA__AHZ41729

SEQ ID NO: 208490 - RNA, 1410 nt, Artificial Sequence; identical to SEQ ID NO: 199752
  derived and/or modified sequence opt5 from neuraminidase__InfluenzaA__AHZ41740

SEQ ID NO: 208491 - RNA, 1410 nt, Artificial Sequence; identical to SEQ ID NO: 199752
  derived and/or modified sequence opt5 from neuraminidase__InfluenzaA__AHZ41751

SEQ ID NO: 208492 - RNA, 1410 nt, Artificial Sequence; identical to SEQ ID NO: 199752
  derived and/or modified sequence opt5 from neuraminidase__InfluenzaA__AHZ41762

SEQ ID NO: 208493 - RNA, 1410 nt, Artificial Sequence; identical to SEQ ID NO: 206413
  derived and/or modified sequence opt5 from neuraminidase__InfluenzaA__AHZ42564

SEQ ID NO: 208494 - RNA, 1410 nt, Artificial Sequence; identical to SEQ ID NO: 205170
  derived and/or modified sequence opt5 from neuraminidase__InfluenzaA__AHZ42575

SEQ ID NO: 208495 - RNA, 1410 nt, Artificial Sequence
  derived and/or modified sequence opt5 from neuraminidase__InfluenzaA__AHZ42587
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaugugcccuaaacccgcugaguaccggaauugguccaagccucagugugggaucaccggauucgcccccuuuucuaaagacaacagcauucgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcaucgccugguccucuagcuccugucaugauggcaaagccuggcuccacgugugcauuacaggcgacgauaagaacgcuaccgccagcuucaucuacaaugggcggcugguugacucuguggucuccuggagcaaagagauucuucgcacccaggaaucugagugugugugcaucaacggaacauguacgguggucaugaccgauggcuccgcuagcgggaaggccgacacaaaaauucuguuuaucgaggaaggaaagaucguucauaccuccacacucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgauuaaugagacaagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggacauccaauucuauuguggucuucugugggaccagcggaacauacggcacgggguccuggccugauggcgcugaccucaaccugaugcccaucuga

SEQ ID NO: 208496 - RNA, 1413 nt, Artificial Sequence
  derived and/or modified sequence opt5 from neuraminidase__InfluenzaA__AHZ42599
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaagaauaaccagguuaugcuuugugaacccacaauuaucgagagaaauauuaccgaaaucguguaucugacaaacaccacgauugagaaagaaaucugcccuaagcccgcugaguaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaaacaggucugcauugccugguccagcagcuccugucaugauggcaaggccuggcuccacgugugcaucacaggcgacgauaaaaacgcuaccgccagcuucauuuacaaugggcggcugguugacucuguggucuccuggagcaaggagauccuucgcacccaggaaucugagugugugugcauuaacggaacauguacgguggucaugaccgauggcuccgcuagcgagaaagccgacacaaagauccuguuuaucgaagaggggaagauuguucauaccuccacacucucuggaagcgcgcaacacguggaagagugcuccugcuaucccagauacccuggcgugcggugugucugccgcgauaacuggaaagggagcaauagacccaucguggacauuaacaucaaggaucacucuauuguuuccagcuacguguguucuggacuggucggcgacaccccgcggaaaaaugacagcuccucuagcucccauugccuugauccuaacaaugaagagggcgggcacggagugaagggcugggccuucgacgaugggaacgacguuuggaugggacgcacgaucaaugagacaagcagacugggcuaugaaaccuuuaaagugaucgagggguggucuaaccccaaguccaaacuccagauuaaucggcaggucaucguggaucgcggagacagaagcggcuacucuggcauuuucuccgucgaagggaagucuuguaucaaccggugcuuuuauguggagcugauuagaggacgcaaggaagagaccgagguucuguggacauccaauucuaucguggucuucuguggcaccagcgggacauacggaacgggcuccuggccugauggggcugaccucaaccugaugcccauuuga

SEQ ID NO: 208497 - RNA, 1410 nt, Artificial Sequence; identical to SEQ ID NO: 207816
  derived and/or modified sequence opt5 from neuraminidase__InfluenzaA__AHZ42611

SEQ ID NO: 208498 - RNA, 1410 nt, Artificial Sequence; identical to SEQ ID NO: 205170
  derived and/or modified sequence opt5 from neuraminidase__InfluenzaA__AHZ42622

SEQ ID NO: 208499 - RNA, 1410 nt, Artificial Sequence; identical to SEQ ID NO: 208357
  derived and/or modified sequence opt5 from neuraminidase__InfluenzaA__AHZ42634

SEQ ID NO: 208500 - RNA, 1410 nt, Artificial Sequence; identical to SEQ ID NO: 208400
  derived and/or modified sequence opt5 from neuraminidase__InfluenzaA__AHZ42646

SEQ ID NO: 208501 - RNA, 1410 nt, Artificial Sequence; identical to SEQ ID NO: 205170
  derived and/or modified sequence opt5 from neuraminidase__InfluenzaA__AHZ42657

SEQ ID NO: 208502 - RNA, 1410 nt, Artificial Sequence; identical to SEQ ID NO: 208117
  derived and/or modified sequence opt5 from neuraminidase__InfluenzaA__AHZ42669

SEQ ID NO: 208503 - RNA, 1410 nt, Artificial Sequence; identical to SEQ ID NO: 205170
  derived and/or modified sequence opt5 from neuraminidase__InfluenzaA__AHZ42681

SEQ ID NO: 208504 - RNA, 1410 nt, Artificial Sequence
  derived and/or modified sequence opt5 from neuraminidase__InfluenzaA__AHZ42693
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuucaaucagaaccuggaauaucagaucggauacauuuguagcggcaucuuuggggauaauccucgccccaacgacaaaaccggaucuugcggcccggucuccagcaauggggccaacggagugaagggcuucuccuuuaaguauggcaaugggguuuggauuggaagaacaaaaucuaucagcucccggaagggcuucgagaugauuugggauccuaacggguggaccggaaccgacaacaauuuuucuaucaaacaagacaucgugggcauuaacgaauggagcggguacuccggcagcuucguccagcaucccgagcuuacaggaauggauuguauccgcccuugcuucuggguggaacugauuagaggccggcccaaggagaauacgaucuggaccucuggguccauuaucagcuuuuguggaguuaacucugacacagugggcugguccuggcccgauggggcugagcucccuuucaccaucgacaaauga

SEQ ID NO: 208505 - RNA, 1410 nt, Artificial Sequence; identical to SEQ ID NO: 205170
  derived and/or modified sequence opt5 from neuraminidase__InfluenzaA__AHZ42704

SEQ ID NO: 208506 - RNA, 1410 nt, Artificial Sequence
  derived and/or modified sequence opt5 from neuraminidase__InfluenzaA__AHZ42716
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccuccucuuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaaguuccagauuaaucggcaggucaucguggaucgcggcgacagaagcggcuacucugggauuuuuagcgucgagggaaaaagcuguaucaaccggugcuucuauguggaacucauuagaggccgcaaggaggaaaccgagguucuguggacauccaauucuaucguggucuucugugggaccagcggaacauacggcacgggguccuggccugauggcgcugaccugaaccucaugcccauuuga

SEQ ID NO: 208507 - RNA, 1410 nt, Artificial Sequence; identical to SEQ ID NO: 205170
  derived and/or modified sequence opt5 from neuraminidase__InfluenzaA__AHZ42728

SEQ ID NO: 208508 - RNA, 1410 nt, Artificial Sequence; identical to SEQ ID NO: 206413
  derived and/or modified sequence opt5 from neuraminidase__InfluenzaA__AHZ42740

SEQ ID NO: 208509 - RNA, 1410 nt, Artificial Sequence; identical to SEQ ID NO: 206381
  derived and/or modified sequence opt5 from neuraminidase__InfluenzaA__AHZ42751

SEQ ID NO: 208510 - RNA, 1410 nt, Artificial Sequence
  derived and/or modified sequence opt5 from neuraminidase__InfluenzaA__AHZ42763
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguuuauaccuccacacucucuggaagcgcgcaacauguggaggaaugcuccugcuaccccagauacccuggcgugcggugugucugccgcgacaacuggaaggggagcaauagacccaucguggauauuaacaucaaagaccacucuauuguuucccgguauguguguagcggacuggucggcgacaccccgcgcaagaaugauucuagcuccucuagccacugccuugacccuaacaaugaggaaggcgggcauggagugaaaggcugggccuucgaugacgggaacgauguuuggaugggaagaacgaucaaugagacaucccggcugggcuacgagaccuuuaaggugaucgaaggguggagcaaccccaaaucuaagcuccagauuaaucgccaggucaucguggacagaggagaucgguccggcuauagcggcauuuucucugucgaggggaaauccuguaucaacagaugcuuuuacguggaacugauucgcggacggaaggaggaaaccgagguucuguggacaagcaauuccaucguggucuucuguggcaccucugggacauauggaacgggcagcuggccugacggggcugaucucaaccugaugcccauuuga

SEQ ID NO: 208511 - RNA, 1410 nt, Artificial Sequence; identical to SEQ ID NO: 206399
  derived and/or modified sequence opt5 from neuraminidase__InfluenzaA__AHZ42775

SEQ ID NO: 208512 - RNA, 1410 nt, Artificial Sequence; identical to SEQ ID NO: 205170
  derived and/or modified sequence opt5 from neuraminidase__InfluenzaA__AHZ42787

SEQ ID NO: 208513 - RNA, 1410 nt, Artificial Sequence
  derived and/or modified sequence opt5 from neuraminidase__InfluenzaA__AHZ42799
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucauugacaucaacauuaaagaucacucuaucguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuauugaaggauggucuaaccccaaauccaagcuccagaucaaucgccaggugauugucgaucggggcgacagaagcggcuacucugggaucuucuccguggagggaaaaagcuguauuaaccggugcuuuuaugucgaacugaucagaggccgcaaggaggaaaccgaggugcuguggacauccaauucuauuguuguguucugugggaccagcggaacauacggcacgggguccuggccugauggcgcugaccucaaccugaugcccaucuga

SEQ ID NO: 208514 - RNA, 1410 nt, Artificial Sequence
  derived and/or modified sequence opt5 from neuraminidase__InfluenzaA__AHZ42811
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucgugggccgcggcgauagaagcggguacucuggaauuuucuccgucgagggcaaaagcuguaucaaccggugcuuuuauguggaacugauuagagggcgcaaggaggaaaccgagguucuguggacauccaauucuaucguggucuucuguggaaccagcggcacauacgggacgggcuccuggccugacggagcugaucucaaccugaugcccauuuga

SEQ ID NO: 208515 - RNA, 1410 nt, Artificial Sequence
  derived and/or modified sequence opt5 from neuraminidase__InfluenzaA__AHZ42823
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgagcaguccguggucucugugaaacuugcggggaacagcucccugugcccuguuagcggaugggcuauuuacucuaaggacaauuccgugagaaucggcagcaaaggggaugucuuugugauccgggaaccguucauuucuuguagcccccucgagugccgcaccuuuuuccugacacagggagcccuucugaacgacaagcauuccaauggcaccaucaaagauagaucuccuuaucggacgcucauguccugucccauuggcgaaguuccuagccccuacaacucccgcuuugagucuguggccuggagcgcuuccgccugccacgacgggaucaacuggcugaccauuggaaucagcggcccugauucuggggcugucgccgugcugaaguauaauggaaucauuacagacaccaucaaguccuggagaaacaauauucuccggacacaagagagcgaaugugcgugcgugaacggcucuuguuucaccaucaugacggaugggccgagcgacggacaggccuccuacaaaauuuuucgcaucgagaagggcaaaaucgucaagucuguugaaaugaaugcucccaacuaucauuacgaggagugcagcuguuacccugauuccagcgaaauuacaugcgugugcagagacaauuggcacggcucuaaccggcccuggguguccuucaaucagaaccuggaguaucagaucggguacauuuguagcggaaucuuuggcgauaauccucgccccaacgacaaaaccgggucuugcggaccggucuccagcaauggcgccaacggggugaagggauucuccuuuaaguauggcaauggcguuuggauugggagaacaaaaucuaucagcucccggaagggauucgaaaugauuugggauccuaacggcuggaccgggaccgacaacaauuuuucuaucaaacaagacaucgugggaauuaacgaguggagcggcuacuccgggagcuucguccagcaucccgaacuuacaggccuggauuguauccgcccuugcuucuggguggagcucauuagaggacggcccaaggagaauacgaucuggaccucuggcuccagcauuucuuuuugugggguuaacuccgacacagugggauggagcuggcccgauggcgcugaacugccuuucaccaucgacaaauga

SEQ ID NO: 208516 - RNA, 1410 nt, Artificial Sequence
  derived and/or modified sequence opt5 from neuraminidase__InfluenzaA__AHZ42834
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacccgcugaguaccggaauugguccaagccucagugugggaucacaggauucgcccccuuuucuaaagacaacagcauucgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcaucgccugguccucuagcuccugucaugauggcaaagccuggcuccacgugugcauuaccggcgacgauaagaacgcuaccgccagcuucaucuacaaugggcggcugguugacucuguggucuccuggagcaaagagauucuucgcacacaggaaucugagugugugugcaucaacggaacguguaccguggucaugacagauggcuccgcuagcgggaaggccgacaccaaaauucuguuuaucgaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 208517 - RNA, 1410 nt, Artificial Sequence; identical to SEQ ID NO: 205170
  derived and/or modified sequence opt5 from neuraminidase__InfluenzaA__AHZ42846

SEQ ID NO: 208518 - RNA, 1410 nt, Artificial Sequence; identical to SEQ ID NO: 205170
  derived and/or modified sequence opt5 from neuraminidase__InfluenzaA__AHZ42858

SEQ ID NO: 208519 - RNA, 1410 nt, Artificial Sequence; identical to SEQ ID NO: 205170
  derived and/or modified sequence opt5 from neuraminidase__InfluenzaA__AHZ42870

SEQ ID NO: 208520 - RNA, 1410 nt, Artificial Sequence; identical to SEQ ID NO: 205170
  derived and/or modified sequence opt5 from neuraminidase__InfluenzaA__AHZ42882

SEQ ID NO: 208521 - RNA, 1410 nt, Artificial Sequence
  derived and/or modified sequence opt5 from neuraminidase__InfluenzaA__AHZ42894
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggauaaaggcgaccgcagcggcuacucugggauuuucuccgucgagggaaagagcuguaucaacagaugcuuuuauguggaacugauucggggcagaaaggaggaaaccgagguucuguggacauccaauucuaucguggucuucugugggaccagcggaacauacggcacgggguccuggccugauggcgcugaccucaaccugaugcccauuuga

SEQ ID NO: 208522 - RNA, 1410 nt, Artificial Sequence; identical to SEQ ID NO: 205170
  derived and/or modified sequence opt5 from neuraminidase__InfluenzaA__AHZ42906

SEQ ID NO: 208523 - RNA, 1410 nt, Artificial Sequence; identical to SEQ ID NO: 206399
  derived and/or modified sequence opt5 from neuraminidase__InfluenzaA__AHZ42918

SEQ ID NO: 208524 - RNA, 1398 nt, Artificial Sequence; identical to SEQ ID NO: 206478
  derived and/or modified sequence opt5 from neuraminidase__InfluenzaA__AHZ59750

SEQ ID NO: 208525 - RNA, 1398 nt, Artificial Sequence; identical to SEQ ID NO: 206478
  derived and/or modified sequence opt5 from neuraminidase__InfluenzaA__AHZ59762

SEQ ID NO: 208526 - RNA, 1398 nt, Artificial Sequence; identical to SEQ ID NO: 206478
  derived and/or modified sequence opt5 from neuraminidase__InfluenzaA__AHZ59774

SEQ ID NO: 208527 - RNA, 1398 nt, Artificial Sequence; identical to SEQ ID NO: 206478
  derived and/or modified sequence opt5 from neuraminidase__InfluenzaA__AHZ59786

SEQ ID NO: 208528 - RNA, 1398 nt, Artificial Sequence; identical to SEQ ID NO: 206478
  derived and/or modified sequence opt5 from neuraminidase__InfluenzaA__AHZ59798

SEQ ID NO: 208529 - RNA, 1398 nt, Artificial Sequence; identical to SEQ ID NO: 206478
  derived and/or modified sequence opt5 from neuraminidase__InfluenzaA__AHZ59810

SEQ ID NO: 208530 - RNA, 1398 nt, Artificial Sequence; identical to SEQ ID NO: 206478
  derived and/or modified sequence opt5 from neuraminidase__InfluenzaA__AHZ59822

SEQ ID NO: 208531 - RNA, 1398 nt, Artificial Sequence; identical to SEQ ID NO: 206478
  derived and/or modified sequence opt5 from neuraminidase__InfluenzaA__AHZ59834

SEQ ID NO: 208532 - RNA, 1398 nt, Artificial Sequence; identical to SEQ ID NO: 206478
  derived and/or modified sequence opt5 from neuraminidase__InfluenzaA__AHZ59846

SEQ ID NO: 208533 - RNA, 1398 nt, Artificial Sequence; identical to SEQ ID NO: 206478
  derived and/or modified sequence opt5 from neuraminidase__InfluenzaA__AHZ59858

SEQ ID NO: 208534 - RNA, 1398 nt, Artificial Sequence; identical to SEQ ID NO: 206478
  derived and/or modified sequence opt5 from neuraminidase__InfluenzaA__AHZ59870

SEQ ID NO: 208535 - RNA, 1398 nt, Artificial Sequence; identical to SEQ ID NO: 206478
  derived and/or modified sequence opt5 from neuraminidase__InfluenzaA__AHZ59882

SEQ ID NO: 208536 - RNA, 1398 nt, Artificial Sequence; identical to SEQ ID NO: 206478
  derived and/or modified sequence opt5 from neuraminidase__InfluenzaA__AHZ59918

SEQ ID NO: 208537 - RNA, 1398 nt, Artificial Sequence; identical to SEQ ID NO: 206478
  derived and/or modified sequence opt5 from neuraminidase__InfluenzaA__AHZ59930

SEQ ID NO: 208538 - RNA, 1398 nt, Artificial Sequence; identical to SEQ ID NO: 206478
  derived and/or modified sequence opt5 from neuraminidase__InfluenzaA__AHZ59942

SEQ ID NO: 208539 - RNA, 1398 nt, Artificial Sequence; identical to SEQ ID NO: 206478
  derived and/or modified sequence opt5 from neuraminidase__InfluenzaA__AHZ59954

SEQ ID NO: 208540 - RNA, 1398 nt, Artificial Sequence; identical to SEQ ID NO: 206478
  derived and/or modified sequence opt5 from neuraminidase__InfluenzaA__AHZ59966

SEQ ID NO: 208541 - RNA, 1398 nt, Artificial Sequence; identical to SEQ ID NO: 206478
  derived and/or modified sequence opt5 from neuraminidase__InfluenzaA__AHZ59991

SEQ ID NO: 208542 - RNA, 1398 nt, Artificial Sequence; identical to SEQ ID NO: 206478
  derived and/or modified sequence opt5 from neuraminidase__InfluenzaA__AHZ60003

SEQ ID NO: 208543 - RNA, 1398 nt, Artificial Sequence; identical to SEQ ID NO: 206478
  derived and/or modified sequence opt5 from neuraminidase__InfluenzaA__AHZ60015

SEQ ID NO: 208544 - RNA, 1398 nt, Artificial Sequence; identical to SEQ ID NO: 206478
  derived and/or modified sequence opt5 from neuraminidase__InfluenzaA__AHZ60027

SEQ ID NO: 208545 - RNA, 1398 nt, Artificial Sequence; identical to SEQ ID NO: 206478
  derived and/or modified sequence opt5 from neuraminidase__InfluenzaA__AHZ60039

SEQ ID NO: 208546 - RNA, 1398 nt, Artificial Sequence; identical to SEQ ID NO: 206478
  derived and/or modified sequence opt5 from neuraminidase__InfluenzaA__AHZ60051

SEQ ID NO: 208547 - RNA, 1398 nt, Artificial Sequence; identical to SEQ ID NO: 206478
  derived and/or modified sequence opt5 from neuraminidase__InfluenzaA__AHZ60063

SEQ ID NO: 208548 - RNA, 1398 nt, Artificial Sequence; identical to SEQ ID NO: 206478
  derived and/or modified sequence opt5 from neuraminidase__InfluenzaA__AHZ60075

SEQ ID NO: 208549 - RNA, 1398 nt, Artificial Sequence; identical to SEQ ID NO: 206478
  derived and/or modified sequence opt5 from neuraminidase__InfluenzaA__AHZ60087

SEQ ID NO: 208550 - RNA, 1398 nt, Artificial Sequence; identical to SEQ ID NO: 206478
  derived and/or modified sequence opt5 from neuraminidase__InfluenzaA__AHZ60099

SEQ ID NO: 208551 - RNA, 1410 nt, Artificial Sequence; identical to SEQ ID NO: 205170
  derived and/or modified sequence opt5 from neuraminidase__InfluenzaA__AHZ60111

SEQ ID NO: 208552 - RNA, 1410 nt, Artificial Sequence; identical to SEQ ID NO: 199426
  derived and/or modified sequence opt5 from neuraminidase__InfluenzaA__AIA26299

SEQ ID NO: 208553 - RNA, 1374 nt, Artificial Sequence
  derived and/or modified sequence opt5 from neuraminidase__InfluenzaA__AIC64891
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacaaauuucgcugccgggcagucuguugugagcgugaaacuugcgggaaacuccucucugugcccugucagcggcugggcuaucuauuccaaggacaauagcgugagaauugggucuaaaggagauguuuuugugauccgggagccguucaucuccuguagcccccucgaaugccgcaccuuuuuccugacacagggcgcccuucugaacgacaagcauucuaauggcaccauuaaagauagauccccuuaccggacacucaugagcugucccaucggggaggucccuucucccuauaacucccgcuuugaaagcguggccugguccgcuucugccugccacgacggaauuaauuggcugaccaucggcauuagcgggccugauaacggagcuguugccgugcugaaguacaacggcaucaucacggacaccauuaaguccuggagaaauaacauccuccggacacaggagagcgagugugcgugcgucaaugggucuuguuucaccgugaugacagauggaccguccaacggccaagccagcuauaaaauuuuucgcaucgaaaagggcaaaauugugaagucugucgagaugaaugcucccaacuaccauuaugaagagugcagcuguuacccugacuccucugagauuaccugcguuugcagagauaauuggcacgggagcaaccggcccuggguguccuucaaucagaaccuggaauaccagaucggauauaucuguagcggcaucuuuggggacaauccucgccccaacgauaaaacgggaucuugcggcccgguguccagcaauggggccaacggagucaagggcuucucuuuuaaguacggcaaugggguguggauuggaagaacaaaauccaucagcucccggaacggcuucgagaugauuugggacccuaacggguggaccggaacagauaauaacuuuucuaucaagcaggacauuguuggcaucaaugaauggagcggguauuccggcucuuucgugcaacaucccgagcuuaccggacuggacuguauccgcccuugcuucugggucgaacucauuagaggccggcccaaagagaacaccaucuggacaagcggguccagcauuucuuuuuguggaguuaauuccgauacggugggcuggagcuggcccgacggggcugagcugccuuucaccaucgauaaguga

SEQ ID NO: 208554 - RNA, 1350 nt, Artificial Sequence
  derived and/or modified sequence opt5 from neuraminidase__InfluenzaA__AID48084
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaaucuucugacagagaaaaccguggcuagcgugaagcucgccgggaacuccucucuguguccgaucaauggaugggcggucuacagcaaagacaacuccauuagaaucggcagcaagggggauguguucguuauucgggaacccuuuaucucuugcucccaucuugaaugucgcacauucuuucugacccagggagcucuccugaaugacaagcacagcaacggcacagugaaagauagaucuccucaucggacccugauguccugccccgucggcgaggccccuagccccuauaauucucgcuucgaauccguggccuggagcgcuuccgccugucacgacgggacgucuuggcucaccauuggaaucagcggcccugauaacggggcuguugccgugcugaaguacaauggaaucauuacagacaccaucaaauccuggagaaacaauauucuucggacacaggagagcgagugcgcgugugucaacggcucuugcuuuaccgugaugacggaugggccguccaacggacaggccagccacaagaucuucaaaauggaaaagggcaagguggucaaaucuguugagcuggacgcucccaauuaucauuacgaagaguguagcugcuauccugaugccggcgagauuacaugugugugccgcgacaacuggcacggguccaauagacccugggugucuuuuaaccaaaaucucgaauaccagaucggauauaucugcagcggcgucuucggggauaacccucggcccaaugacggagcuggcuccugugggccggugagcucuaacggagccuacggcguuaagggcuuuuccuucaaauacgggaauggaguguggauuggccgcaccaagagcacaaacucuagauccggguuugagaugaucugggauccuaauggauggaccgaaaccgacagcuccuucucugucaaacaggacauuguggcgaucacagauuggagcggcuauuccgggucuuuuguucagcaucccgagcugacgggccuugacugcauucggccuuguuucuggguggaacugauccgcggaagacccaaggagagcaccaucuggacauccggcagcucuauuuccuucugcggggucaacagcgauaccgugggauggucuuggcccgacggcgccgagcucccuuuuacaaucgauaaauga

SEQ ID NO: 208555 - RNA, 1410 nt, Artificial Sequence
  derived and/or modified sequence opt5 from neuraminidase__InfluenzaA__AID70507
augaaccccaaucagaagaucauuaccaucggcagcgugugcacaacgauugggauggccaaccugauccuccaaauuggaaauaucaucuccauuuggaucucucacagcauucagcugggcaaccagaaucagaucgagaccuguaaccaauccgucauuacauacgaaaauaaaaccuggguuaaccagacauaugugaauaucucuaacaccaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcacauuuuuccugacccagggcgcccuucugaacgacaaacauuccaauggcacgauuaaggauagaagcccuuaucggacccucaugucuugucccaucggggaggugccuucccccuacaacagccgcuuugaauccguugccuggucugcuagcgccugccacgacggaauuaacuggcugacaaucggcaucuccgggccugauaauggagcuguggccguccugaaguauaacggcauuaucaccgacacaauuaaaagcuggagaaauaacauccuccggacccaagagucugagugugcgugcgugaauggguccuguuucacggugaugacagauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuaccugcgugugcagagacaacuggcacggguccaaucggcccugggugagcuucaaccagaaucuggaauaucagaucggauacauuuguucuggcaucuuuggggauaacccucgccccaaugacaagacaggauccugcgauccggucagcuucaacggcgccaauggggugaagggauuuucuuucaaauauggcaacggcguuuggauugggagaaccaaguccaucagcucccggaacggauuugagaugauuugggacccuaauggcuggaccgggacagacaacaaauucucuaucaagcaagauaucgugggaauuaaugaauggagcggcuacuccgggucuuucguccagcaucccgagcuuacgggccuggacuguauccgcccuugcuuuuggguggaacucauuagaggacggcccaaagagaacaccaucuggacaagcggcuccagcauuucuuucugugggguuaauuccgauaccgugggaugguuuuggcccgacggcgcugagcugccuuucacaaucgauaaguga

SEQ ID NO: 208556 - RNA, 1410 nt, Artificial Sequence
  derived and/or modified sequence opt5 from neuraminidase__InfluenzaA__AID70508
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccuaauaacggagcuguggccguccugaaguauaauggcauuaucacagauaccauuaagucuuggagaaacaauauccuccggacacaagaguccgagugugcgugcgugaacgggagcuguuucaccauuaugacggacggaccgucugauggccaggccagcuacaaaaucuuucgcaucgaaaagggcaaaauugugaaguccgucgagaugaaugcucccaacuaucauuacgaagagugcucuuguuacccugacagcuccgagaucacaugcguuugcagagauaauuggcacgggagcaaccggcccugggugucuuucaaucagaaccuggaauaucagauuggauacaucuguuccggcauuuuuggggacaauccucgccccaacgauaaaaccggaagcugcggcccggugucuuccaauggggccaacggagucaagggcuucagcuuuaaguauggcaacgggguguggaucggaagaacaaaauccauuucuagccggaagggcuucgagaugaucugggacccuaauggguggaccggaaccgauaacaauuuuuccaucaaacaagacauuguuggcaucaacgaauggucuggguacagcggcuccuucgugcagcaucccgagcuuacaggacuggacuguauucgcccuugcuucugggucgaacucaucagaggccggcccaaggagaauacgauuuggaccagcgggucuuccaucagcuuuuguggagugaacucugauacaguuggcugguccuggcccgacggggcugagcugccuuucaccaucgauaaauga

SEQ ID NO: 208557 - RNA, 1410 nt, Artificial Sequence
  derived and/or modified sequence opt5 from neuraminidase__InfluenzaA__AID70509
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuaacucucggaagggcuucgagaugaucugggauccuaauggguggaccggaaccgacaacaauuuuagcaucaaacaagacauuguuggcaucaacgaaugguccggguacucuggcagcuucgugcagcaucccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 208558 - RNA, 1410 nt, Artificial Sequence
  derived and/or modified sequence opt5 from neuraminidase__InfluenzaA__AID70510
augaaccccaaucagaagaucauuaccaucggcagcgugugcauuacaaucgggauggccaaccugauucuccaaaucggaaauaucauuuccaucuggauuucucacagcauccagcugggcaaccagucccagauugagacguguaaucaaucugucaucaccuacgaaaacaauacauggguuaaccagaccuaugugaauauuagcaacacaaauuucgcugccgggcaguccguggucucugugaaacuugcgggaaacagcucccugugcccuguuagcggcugggcuaucuacucuaaggacaauuccaucagaauugggagcaaaggagauguguuugucauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggugccuagccccuacaacucccgcuuugaaucuguugccuggagcgcuuccgccugccacgacggaaucaacuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccaucaugacggauggaccgucugacggccaggccagcuacaaaaucuuucgcauugaaaagggcaaaaucgugaaguccgucgagaugaacgcucccaauuaucauuacgaagagugcucuuguuacccugauagcuccgagauuacaugcguuugcagagacaacuggcacgggagcaaucggcccugggugucuuucaaccagaaucuggaauaucagaucggauacauuuguuccggcaucuuuggggauaacccucgccccaaugacaaaaccggaagcugcggcccggugucuuccaacggggccaauggagucaagggcuucagcuuuaaguauggcaacgggguguggauuggaagaacaaaauccaucucuagccggaagggcuucgagaugaucugggauccuaacggguggaccggaaccgacaauaacuuuuccauuaaacaagacaucguuggcauuaaugaauggucuggguacagcggcuccuucgugcagcaucccgagcuuacaggacuggauuguauccgcccuugcuucugggucgaacucauuagaggccggcccaaggagaacacgaucuggaccagcgggucuuccaucagcuuuuguggaguuaauucugacacagugggcugguccuggcccgauggggcugagcugccuuucaccauugacaaauga

SEQ ID NO: 208559 - RNA, 1410 nt, Artificial Sequence
  derived and/or modified sequence opt5 from neuraminidase__InfluenzaA__AID70511
augaaccccaaucagaagaucauuaccaugggcagcguguggaugacaaucgggauggccaaccugauucuccaauccggaaauaucauuucuaucuggaucagccacuccauucagcugagaaaccagucucagaucgagacgugcaaucaaagcgucauuaccuacgaaaacaauacauggguuaaccagaccuaugugaauaucuccaacacaaauuucgcugccggccagucuguggucagcgugaaacuugcggggaacuccagccuguguccuguuucuggaugggcuauuuacuccaaggacaauagcauccggauuggcucuaaaggggauguguuugucauccgcgagccguucaucuccugcagcccccucgaauguagaaccuuuuuccugacacagggagcccuucugaacgacaagcauucuaauggcaccauuaaagaucgguccccuuaucgcacgcucaugagcugccccaucggcgaggugccuucccccuacaacucuagauuugaaagcguugccugguccgcuagcgccugucacgacgggauuaacuggcugaccaucggaauuucuggcccugauaauggggcuguggccguccugaaguauaacggaaucaucacagacaccauuaaguccuggcggaauaacauccuccgcacacaagagagcgagugcgcgugugugaauggcucuugcuucaccauuaugacggaugggccgagcgacggacaggccuccuacaaaaucuuuagaauugaaaagggcaaaaucgugaagucugucgagaugaacgcucccaauuaucauuacgaagaguguagcugcuacccugauuccagcgagaucacauguguuugccgggacaacuggcacggcucuaaucgccccuggguguccuucaaccagaaucuggaauaucagauuggguacaucugcagcggaauuuuuggcgauaacccuagacccaaugacaaaaccgggucuuguggaccgguguccagcaacggcgccaauggggucaagggauucuccuuuaaguauggcaacggcguguggaucgggcggacaaaaucuauuagcucccgcaagggauucgagaugaucugggauccuaacggcuggaccgggaccgacaauaacuuuucuauuaaacaagacaucguuggaaucaaugaauggagcggcuacuccgggagcuucgugcagcaucccgagcuuacaggccuggauugcauuagaccuuguuucugggucgaacucauccggggacgccccaaggagaacacgauuuggaccucuggcuccagcaucucuuuuugcgggguuaauuccgacacagugggauggagcuggcccgauggcgcugagcugccuuucaccauugacaaauga

SEQ ID NO: 208560 - RNA, 1410 nt, Artificial Sequence
  derived and/or modified sequence opt5 from neuraminidase__InfluenzaA__AID70512
augaaccccaaucagaagaucauuaccaucggcagcguguggaugacaauugggauggccaaccugauccuccaaauuggaaauaucaucuccauuuggaucucucacagcauucagcugggcaaccagucccagaucgagacgugcaaucaaucugucauuaccuacgaaaacaauacauggguuaaccagaccuaugugaauaucagcaacacaaauuucgcugccgggcaguccguggucucugugaaacuugcgggaaacagcucccuguguccuguuagcggcugggcuauuuacucuaaggacaauuccaucagaaucgggagcaaaggagauguguuugucauucgggagccguucaucucuugcagcccccucgaaugucgcaccuuuuuccugacacagggcgcccuucugaacgacaagcauuccaauggcaccauuaaagauagaucuccuuaucggacgcucauguccugccccaucggggaggugccuagccccuacaacucccgcuuugaaucuguugccuggagcgcuuccgccugucacgacggaauuaacuggcugaccaucggcaucagcgggccugauaauggagcuguggccguccugaaguauaacggcauuaucacagacaccauuaagucuuggagaaauaacauccuccggacacaagaguccgagugcgcgugugugaaugggagcugcuucaccauuaugacggauggaccgucugacggccaggccagcuacaaaaucuuucgcaucgaaaagggcaaaauugugaaguccgucgagaugaaagcucccaacuaucauuacgaagaguguucuugcuacccugauagcuccgagaucacauguguuugcagagacaauuggcacgggagcaaccggcccugggugucuuucaaucagaaccuggaauaucagauuggauacaucugcuccggcauuuuuggggauaauccucgccccaacgacaagaccggaagcuguggcccggugucuuccaauggggccaacggagucaagggcuucagcuuuaaauauggcaaugggguguggaucggaagaacaaaguccauuucuagccggaaaggcuucgagaugaucugggauccuaacggguggaccggaaccgacaacaauuuuuccaucaagcaagacauuaucggcauuaacgaauggucuggguacagcggcuccuucguucagcaucccgagcuuacaggacuggauugcauccgcccuuguuucuggguggaacucauuagaggccggcccaaagagaauacgaucuggaccagcgggucuuccaucagcuuuugcggagucaacucugacacagugggcugguccuggcccgauggggcugagcugccuuucaccauugacaaguga

SEQ ID NO: 208561 - RNA, 1410 nt, Artificial Sequence; identical to SEQ ID NO: 203281
  derived and/or modified sequence opt5 from neuraminidase__InfluenzaA__AID70514

SEQ ID NO: 208562 - RNA, 1410 nt, Artificial Sequence
  derived and/or modified sequence opt5 from neuraminidase__InfluenzaA__AID70515
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguagcccccucgaaugcagaaccuuuuuccugacacagggagcccuucugaacgacaagcauuccaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucacaugcguuugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggugucuuccaacggcgccaauggggucaagggauucagcuuuaaguauuccaacggcguguggaucggccggacaaaaucuauuagcucccgcaagggguucgagaugaucugggauccuaacggauggaccggcaccgacaauaacuuuucuaucaaacaagacauuguugggaucaaugaauggagcggauacuccggcagcuucgugcagcaucccgagcuuacagggcuggauuguauuagaccuugcuucugggucgaacucauccggggccgccccaaggagaacacgauuuggaccucuggauccagcaucucuuuuuguggcguuaauuccgacacagugggguggagcuggcccgauggagcugagcugccuuucaccaucgacaaauga

SEQ ID NO: 208563 - RNA, 1410 nt, Artificial Sequence; identical to SEQ ID NO: 206182
  derived and/or modified sequence opt5 from neuraminidase__InfluenzaA__AID70516

SEQ ID NO: 208564 - RNA, 1410 nt, Artificial Sequence
  derived and/or modified sequence opt5 from neuraminidase__InfluenzaA__AID70517
augaaccccaaucagaagaucauuaccaucggcagcgugugcaugacaauugggauggccaaccugacgcuccaaaucggaaauauuaucuccaucuggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacgaucaugacagauggaccgaaugacggccaggccagcuacaaaauuuuucgcaucgaaaagggcaaaaucgugaagucugucgagaugaacgcucccaauuaucauuacgaagagugcagcuguuacccugauuccucugagauuaccugcguuugcagagacaacuggcacgggagcaaucggcccuggguguccuucaaccagaaucuggaauaucagaucggauacauuuguagcggcaucuuuggggauaacccucgccccaaugacaaaacaggaucuugcggcccgguguccagcaacggggccaacggagucaagggcuucucuuuuaaguauggcaaugggguguggauuggaagaaccaaauccaucagcucccggaagggcuucgagaugauuugggauccuaacggguggaccggaacagacaauaacuuuucuaucaaacaagacaucguuggcauuaaugaauggagcggguacuccggcucuuucgugcagcaucccgagcuuacgggacuggauuguauccgcccuugcuucugggucgaacucauuagaggccggcccaaggagaacaccaucuggacaagcggguccagcauuucuuuuuguggaguuaauuccgacaccgugggcuggagcuggcccgauggggcugagcugccuuucacaaucgacaaauga

SEQ ID NO: 208565 - RNA, 1410 nt, Artificial Sequence
  derived and/or modified sequence opt5 from neuraminidase__InfluenzaA__AID70518
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgagauuccuagccccuacaacuccagauuugaaucuguggccuggagcgcuuccgccugccacgacgggaucaacuggcugaccaucggaauuagcggcccugauaauggggcuguugccgugcugaaguauaacggaaucauuacagacaccaucaagucuuggcggaauaacauucuccgcacacaagaguccgagugugcgugcgucaauggcagcuguuucaccaucaugacggaugggccgucugacggacaggccagcuacaaaaucuuuagaauugaaaagggcaaaaucgugaaguccguggagaugaacgcucccaauuaucauuacgaagagugcucuuguuacccugauagcuccgagauuacaugcgucugccgggacaacuggcacggcagcaaucgccccuggguuucuuucaaccagaaucuggaauaucagaucggguacauuuguuccggaaucuuuggcgauaacccuagacccaaugacaaaaccgggagcugcggaccggugucuuccaacggcgccaauggggugaagggauucagcuuuaaguauggcaacggcgucuggauugggcggacaaaauccaucucuagccgcaagggauucgagaugaucugggauccuaacggcuggaccgggaccgacaauaacuuuuccauuaaacaagacaucgugggaauuaaugaauggucuggcuacagcggguccuucguucagcaucccgagcuuacaggccuggauuguaucagaccuugcuucuggguggaacucauucggggacgccccaaggagaacacgaucuggaccagcggcuccuccaucagcuuuuguggggucaauucugacacagugggaugguccuggcccgauggcgcugagcugccuuucaccauugacaaauga

SEQ ID NO: 208566 - RNA, 1410 nt, Artificial Sequence
  derived and/or modified sequence opt5 from neuraminidase__InfluenzaA__AID70519
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaaagcucccaacuaucauuacgaagagugcucuuguuacccugauagcuccgagaucacaugcguuugcagagacaauuggcacgggagcaaccggcccugggugucuuucaaucagaaccuggaauaucagauuggauacaucuguuccggcauuuuuggggauaauccucgccccaacgacaagaccggaagcugcggcccggugucuuccaauggggccaacggagucaagggcuucagcuuuaaauauggcaaugggguguggaucggaagaacaaaguccauuucuagccggaaaggcuucgagaugaucugggauccuaacggguggaccggaaccgacaacaauuuuuccaucaagcaagacauuguuggcaucaacgaauggucuggguacagcggcuccuucgugcagcaucccgagcuuacaggacuggauuguauucgcccuugcuucugggucgaacucaucagaggccggcccaaagagaauacgauuuggaccagcgggucuuccaucagcuuuuguggagugaacucugacacaguuggcugguccuggcccgauggggcugagcugccuuucaccaucgacaaguga

SEQ ID NO: 208567 - RNA, 1410 nt, Artificial Sequence
  derived and/or modified sequence opt5 from neuraminidase__InfluenzaA__AID70520
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucacaugcguuugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggugucuuccaacggcgccaauggggucaagggauucagcuuuaaguauggcaacggcguguggaucgggcggacaaaauccauuucuagccgcaagggauucgagaugaucugggauccuaacggcuggaccgggaccgacaauaacuuuuccaucaaacaagacauuguuggaaucaaugaauggucuggcuacagcggguccuucgugcagcaucccgagcuuacaggccuggauuguauuagaccuugcuucugggucgaacucauccggggacgccccaaggagaacacgauuuggaccagcggcuccuccaucagcuuuugugggguuaauucuggaacagugggcugguccuggcccgacggggcugagcugccuuucaccaucgauaaauga

SEQ ID NO: 208568 - RNA, 1410 nt, Artificial Sequence
  derived and/or modified sequence opt5 from neuraminidase__InfluenzaA__AID70521
augaaccccaaucagaagaucauuaccaucggcagcgugucccugacaauuucuagaaucugcuucuuuaugcaaauugccauccucaucaacacggucacccugcacuucaaacaguacgaguuuaauagcccuccgaacaaucagguuaugcuuugugaacccacaauuaucgagcggaacauuaccaagaucguguaucugacaaauaccacaauugaaaaagagaucugcccuaagcucgcugaauaccgcuccuggucuaaaccccagugugacauuaccggguucgccccuuuuagcaaggauaacuccaucagacugucugcgggaggcgacaucugggugacgcgggagcccuaugucagcugcgauccugacaaguguuuccaauuugcucuugggcagggaaccacacugaauaacgugcauuccaaugauaccguucacgaccgcacaccguacagaacccuccugaugaacgagcugggcgugcccuuccaucucgggacgaaacaggucugcauugccugguccucuuccagcugucacgauggaaaggccuggcugcaugugugcaucacaggcgacgauaaaaaugcuaccgccucuauuaucuauaacggccggcuuguugacuccauugugagcuggucuaagaaaauccugcgcacacaggaauccgagugugucugcaucaaugggaccuguaccguggugaugacagauggaagcgcuuccggcaaggccgacacgaagauucucuuuaucgaagaggggaaaauuguccacaccucuacacugagcggauccgcgcaacacguugaggaaugcagcugcuacccuagauaucccggcgugcggugugugugccgcgauaacuggaaggggucuaacagaccuaucgucgacauuaauaucaaagacuacuccaucgugagcucuuacguuuguagcggauucgugggcgauacaccccggaagccggaccgcuccucuagcucccauugccuugauccuaacaaugaggaaggcgggcacggagucaaaggcugggccuuugacgaugggaacgacguguggaugggaagaaccauuagcgagaagucucggcugggcuaugaaaccuucaaaguuaucgggggaugguccaaucccaacagcaagucucagauuaaucgccaggugaucgucgauagaggcaaccgguccggcuacagcgggauuuuuagcguggagggaaagucuuguaucaauagaugcuucuaugucgagcucauucgcggccggaaagacgaaacggaggugcuguggacaagcaacuccaucguuguguucugugggaccucuggaaccuacggcacagggagcuggccugauggcgcugacaucaaucugaugcccauuuga

SEQ ID NO: 208569 - RNA, 1410 nt, Artificial Sequence
  derived and/or modified sequence opt5 from neuraminidase__InfluenzaA__AID70522
augaaccccaaucagaagaucauuaccaucggcagcgugucccugacaauuucuacgaucugcuucuuuaugcaaauugccauccucaucaccacagucacccugcacuucagacaguacgaguuuaacagcccuccgaauaaccagguuaugcuuugugaacccacaauuaucgagcggaauauuaccgaaaucguguaucugacaaacaccacgauugagaaagaaaucugcccuaagcucgcugaguaccgcaauugguccaaaccccagugugacauuaccggguucgccccuuuuucuaaggauaacagcaucagacuguccgcgggaggcgacaucugggugacacgggagcccuaugucucuugcgauccugacaaauguuaccaauucgcucuugggcagggaaccacacugaauaacgugcauagcaauaacaccguucgcgauagaacgccguaucggacacuccugaugaaugaacugggcgugcccuuucaccucgggaccaagcaggucugcauugccugguccagcagcuccugucaugacggaaaggccuggcugcacgugugcaucacaggcgaugacaaaaacgcuaccgccagcuucauuuacaauggccgccuuguugauucuguggucuccuggagcaaggagauccugagaacccaggaaucugagugugugugcauuaacgggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucaaugagacaagccggcucggcuaugagaccuuuaaagugaucgaaggguggucuaacccuaaguccaaacugcagauuaaucgccaggucaucguggacagaggaaaccggagcggcuacucuggcauuuucuccgucgaggggaagucuuguaucaauagaugcuuuuauguggaacugauucgcggacggaaagaggaaaccgagguucucuggacauccaacucuaucguggucuucuguggcaccagcgggacauacggaacgggcuccuggcccgauggggcugaccugaaucuuaugccuauuuga

SEQ ID NO: 208570 - RNA, 1410 nt, Artificial Sequence
  derived and/or modified sequence opt5 from neuraminidase__InfluenzaA__AID70523
augaaccccaaucagaagaucaaaaccauuggcagcgugucccugacaaacucuacgaucugcauuuucaugcaaaucgccauucucaucaccacagucacccugcacuuuaagcaguacgaguucaauagcccuccgaacaaucagguuaugcuuugugaacccacaaucauugagagaaacaucaccgaaauuguguaucugacaaauaccacgaucgagaaagaaauuugcccuaagcucgcugaguaccggaacugguccaaaccccagugugacaucaccggguuugccccuuucucuaaggauaauagcauucgccuguccgcgggaggcgacaucugggugacaagagagcccuaugucucuugcgauccugacaaguguuaccaauuugcucuugggcagggaaccacacugaacaaugugcauagcaacaauaccguucgggaucgcacgccguauagaacacuccugaugaacgaacugggcgugcccuuccaccucgggaccaaacaggucugcaucgccugguccagcagcuccugucaugacggaaaggccuggcugcacgugugcauuacaggcgaugacaaaaaugcuaccgccagcuuuaucuacaacggccggcuuguugauucuguggucuccuggagcaaggagauucugcgcacccaggaaucugagugugugugcaucaacgggacauguacgguggucaugaccgacggauccgcuagcggcaaagccgauacaaagauucucuucaucgaggaagggaagaucguucauaccuccacacugucuggaagcgcgcaacacguggaggaaugcuccugcuauccuagauaccccggcgugcggugugucugccgcgacaauuggaaagggagcaacagaccuauuguggauaucaauauuaaggaccacucuaucguuuccagcuacguguguucuggacuugucggcgacacgccccggaaaaacgauagcuccucuagcucccauugccuggacccgaauaacgaggaaggcgggcacggagugaagggcugggccuuugaugacgggaaugauguuuggaugggacgcaccauuaacgagacaagcagacucggcuaugagaccuucaaagugaucgaaggguggucuaauccuaaguccaaacugcagaucaaccggcaguuuauugucgaccgcggaaauagaagcggcuacucuggcaucuucuccguggaggggaagucuuguauuaaccggugcuuuuaugucgaacugaucagaggacgcaaggaggaaaccgaggugcucuggacauccaauucuauuguuguguucuguggcaccagcgggacauacggaacgggcuccuggcccgauggggcugaccugaaccuuaugccuaucuga

SEQ ID NO: 208571 - RNA, 1410 nt, Artificial Sequence
  derived and/or modified sequence opt5 from neuraminidase__InfluenzaA__AID70524
augaaccccaaucagaagaucauuaccaucggcgccguguggagaacaauuagcacgaucugcuucuuuaugcaaauugcuuuccugaucaccacagucacccuccacuuuaaacaguacgaguucaacuccccuccgaauaaccagguuaugcccugugaaccuacaaucauugagcggaauaucaccgaaauuguguaucugacaaacaccacgaucgagaaggaaauuugccccaaacuugccgaguaccgcaauuggucuaagccucagugugacaucaccggguuugcgcccuucagcaaagauaacuccauuagacugucugcuggaggcgacaucugggugacacgggagccuuaugucagcugcgauccggacaaguguuaccaauuugcccucgggcagggaaccacacugaauaacgugcauuccaauaacaccguucgcgauagaacgcccuaucggacacuucugaugaaugaacucggcgugccuuuccaccuggggaccaagcaggucugcaucgccuggucuagcuccagcugucaugacggaaaggcuuggcugcacgugugcauuacaggcgaugacaaaaacgccaccgcuucuuuuaucuacaauggccgccucguugauuccguggucagcuggucuaaagagauucugagaacccaggaauccgagugugugugcaucaacgggacauguacgguggucaugaccgacggaagcgccucuggcaaggcggauacaaaaauucuuuucaucgaggaagggaagaucguucauaccuccacacugagcggauccgcccaacacguggaggaaugcucuugcuauccccgguacccuggcgugcgcugugucugcagagacaacuggaaggggagcaaucggcccauuguggauaucaacauuaaagaccacuccaucguuagcucuuacguguguuccggacucgucggcgacaccccgcgcaagaaugauagcucuagcuccucucauugccuggacccuaacaaugaggaaggcgggcacggagugaaaggcugggcuuuugaugacgggaacgauguuuggaugggaagaacgauuaaugagacaagccggcuuggcuaugagaccuucaaggugaucgaagggugguccaaccccaaaagcaagcugcagaucaaucgccaggucauuguggacagaggaaaccggucuggcuacuccggcaucuuuagcgucgaggggaaaucuuguauuaauagaugcuucuauguggaacucauccgcggacggaaggaggaaaccgagguucuguggacauccaacagcauuguggucuucuguggcaccuccgggacauacggaacgggcucuuggccugauggggccgaccugaaucucaugcccaucuga

SEQ ID NO: 208572 - RNA, 1410 nt, Artificial Sequence
  derived and/or modified sequence opt5 from neuraminidase__InfluenzaA__AID70525
augaaccccaaucagaagaucauuaccaucggcagcgugucccugacaauuuggaucauuugcuucuuuaugcaaaucgccauccucauuacgaccgucacacugcacuucaaacaguacgaguuuaacucuccuccgaauaaccagguuaugcuuugugaacccaccaucauugagagaaauaucacagaaauuguguaucugaccaacacaaccaucgagaaggaaauuugcccuaaacucgcugaguaccggaauuggagcaagccccagugugacaucacgggguucgccccuuuuuccaaagauaacucuauccgccugagcgcgggaggcgacauuugggugaccagagagcccuaugucuccugcgauccugacaaguguuaccaauucgcucuugggcagggaacaacccugaauaacgugcauucuaauaacacaguucgggaucgcaccccguauagaacgcuccugaugaaugaacugggcgugcccuuucaccucgggacaaagcaggucugcaucgccuggagcuccagcucuugucaugacggaaaagccuggcugcacgugugcauuaccggcgaugacaagaacgcuacagccuccuucaucuacaauggccggcuuguugauagcguggucucuugguccaaagagauucugcgcacccaggaaagcgagugugugugcaucaacgggaccuguacaguggucaugacggacggaucugcuuccggcaaggccgauaccaaaauccucuuuauugaggaagggaagaucguucauacaagcacccuguccggaucugcgcaacacguggaggaaugcagcugcuauccuagauaccccggcgugcggugugucugccgcgacaacuggaagggguccaauagaccuauuguggauaucaacauuaaagaccacagcaucguuucuuccuacguguguagcggacuugucggcgacacaccccggaagaaugauucuagcuccucuagccauugccuggacccgaacaaugaggaaggcgggcacggagugaaaggcugggccuucgaugacgggaacgauguuuggaugggacgcaccaucaaugagacguccagacucggcuaugagacauuuaaggugauugaaggguggagcaacccuaaaucuaagcugcagaucaaucggcaggucauuguggaccgcggaaacagauccggcuacagcggcaucuucucugucgaggggaaauccuguauuaaucggugcuuuuauguggaacugaucagaggacgcaaggaggaaaccgagguucucuggaccagcaacuccauuguggucuucuguggcacaucugggaccuacggaacaggcagcuggcccgauggggcugaccugaauaucaugccuaucuga

SEQ ID NO: 208573 - RNA, 1410 nt, Artificial Sequence; identical to SEQ ID NO: 202542
  derived and/or modified sequence opt5 from neuraminidase__InfluenzaA__AID70526

SEQ ID NO: 208574 - RNA, 1410 nt, Artificial Sequence
  derived and/or modified sequence opt5 from neuraminidase__InfluenzaA__AID70527
augaaccccaaucagaagaucauuaccaucggcagcgugucccugacaauguggauuaucugcuucuuuaugcaaauugccauccucaucacgaccgucacacugcacuucaaacaguacgaguuuaacucuccuccgaauaaccagguuaugcuuugugaacccaccauuaucgagagaaauauuacagaaaucguguaucugaccaacacaaccauugagaaggaaaucugcccuaaacucgcugaguaccggaauuggagcaagccccagugugacauuacgggguucgccccuuuuuccaaagauaacucuauccgccugagcgcgggaggcgacaucugggugaccagagagcccuaugucuccugcgauccugacaaguguuaccaauucgcucuugggcagggaacaacccugaauaacgugcauucuaauaacacaguucgggaucgcaccccguauagaacgcuccugaugaaugaacugggcgugcccuuucaccucgggacaaagcaggucugcauugccuggagcuccagcucuugucaugacggaaaagccuggcugcacgugugcaucaccggcgaugacaagaacgcuacagccuccuucauuuacaauggccggcuuguugauagcguggucucuugguccaaagagauccugcgcacccaggaaagcgagugugugugcauuaacgggaccuguacaguggucaugacggacggaucugcuuccggcaaggccgauaccaaaauccucuuuaucgaggaagggaagauuguucauacaagcacccuguccggaucugcgcaacacguggaggaaugcagcugcuauccuagauaccccggcgugcggugugucugccgcgacaacuggaagggguccaauagaccuaucguggauauuaacaucaaagaccacagcauuguuucuuccuacguguguagcggacuugucggcgacacaccccggaagaaugauucuagcuccucuagccauugccuggacccgaacaaugaggaaggcgggcacggagugaaaggcugggccuucgaugacgggaacgauguuuggaugggacgcaccaucaaugagacguccagacucggcuaugagacauuuaaggugaucgaaggguggagcaacccuaaaucuaagcugcagauuaaucggcaggucaucguggaccgcggaaacagauccggcuacagcggcauuuucucugucgaggggaaauccuguaucaaucggugcuuuuauguggaacugauuagaggacgcaaggaggaaaccgagguucucuggaccagcaacuccaucguggucuucuguggcacaucugggaccuacggaacaggcagcuggcccgauggggcugaccugaaucuuaugccuauuuga

SEQ ID NO: 208575 - RNA, 1410 nt, Artificial Sequence
  derived and/or modified sequence opt5 from neuraminidase__InfluenzaA__AID70528
augaaccccaaucagaagaucauuaccaucggcagcgugucccugucuauuagcacaaucugcuucuuuaugcaaauugccauccucaucacgaccgucacacugcacuucaaacaguacgaguuuaacuccccuccgaauaaccagguuaugcuuugugaacccaccauuaucgagagaaauauuacagaaaucguguaucugaccaacacaaccauugagaaggaaaucugcccuaaacucgcugaguaccggaauuggucuaagccccagugugacauuacgggguucgccccuuuuagcaaagauaacuccauccgccugucugcgggaggcgacaucugggugaccagagagcccuaugucagcugcgauccugacaaguguuaccaauucgcucuugggcagggaacaacccugaauaacgugcauuccaauaacacaguucgggaucgcaccccguauagaacgcuccugaugaaugaacugggcgugcccuuucaccucgggacaaagcaggucugcauugccuggucuagcuccagcugucaugacggaaaagccuggcugcacgugugcaucaccggcgaugacaagaacgcuacagccucuuucauuuacaauggccggcuuguugauuccguggucagcuggucuaaagagauccugcgcacccaggaauccgagugugugugcauuaacgggaccuguacaguggucaugacggacggaagcgcuuccggcaaggccgauaccaaaauccucuuuaucgaggaagggaagauuguucauacaucuacccugagcggauccgcgcaacacguggaggaaugcagcugcuauccuagauaccccggcgugcggugugucugccgcgacaacuggaaggggucuaauagaccuaucguggauauuaacaucaaagaccacuccauuguuagcucuuacguguguagcggacuugucggcgacacaccccggaagaaugauuccucuagcuccagccauugccuggacccgaacaaugaggaaggcgggcacggagugaaaggcugggccuucgaugacgggaacgauguuuggaugggacgcaccaucaaugagacgucuagacucggcuaugagacauuuaaggugaucgaagggugguccaacccuaaaagcaagcugcagauuaaucggcaggucaucguggaccgcggaaacagaucuggcuacuccggcauuuucagcgucgaggggaaauccuguaucaaucggugcuuuuauguggaacugauuagaggacgcaaggaggaaaccgagguucucuggaccucuaacagcaucguggucuucuguggcacauccgggaccuacggaacaggcucuuggcccgauggggcugaccugaaucuuaugccuauuuga

SEQ ID NO: 208576 - RNA, 1410 nt, Artificial Sequence; identical to SEQ ID NO: 202542
  derived and/or modified sequence opt5 from neuraminidase__InfluenzaA__AID70529

SEQ ID NO: 208577 - RNA, 1410 nt, Artificial Sequence
  derived and/or modified sequence opt5 from neuraminidase__InfluenzaA__AID70530
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaauauuaugccuaucuga

SEQ ID NO: 208578 - RNA, 1410 nt, Artificial Sequence; identical to SEQ ID NO: 202542
  derived and/or modified sequence opt5 from neuraminidase__InfluenzaA__AID70531

SEQ ID NO: 208579 - RNA, 1410 nt, Artificial Sequence
  derived and/or modified sequence opt5 from neuraminidase__InfluenzaA__AID70532
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuucuuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagacccugaaggugaucgaaggguggucuaacccuaaauccaagcugcagauuaaucggcaggucaucguggaccgcggaaacagaagcggcuacuauggcauuuuuagcgucgaggggaaauccuguaucaaucggugcuucuacguggaacucauuuggggaagaaaggaggaaaucgagguucuguggaccagcaacuccaagguggucuuuuguggcacaucugggaccuauggaacaggcagcucccccgauggggcugaccuuaauuucaugccuauuuga

SEQ ID NO: 208580 - RNA, 1410 nt, Artificial Sequence
  derived and/or modified sequence opt5 from neuraminidase__InfluenzaA__AID70533
augaaccccaaucagaagaucauuaccaucggcagcgugucccuggccauuucuacaaucugcuucuuuaugcaaauugcuauccucaucacgaccgucacacugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaauaacacaguucgggaucgcaccccguauagaacgcuccugaugaaugaacugggcgugcccuuucaccucgggacaaagcaggucugcauugccugguccucuagcuccugucaugacggaaaggcuuggcugcacgugugcaucaccggcgaugacaaaaacgccacagcuagcuucauuuacaauggccggcuuguugauucuguggucuccuggagcaaagagauccugcgcacccaggaaucugagugugugugcauuaacgggaccuguacaguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucaaugagacgagcagacucggcuaugagacauuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggaccuccaacucuaucguggucuucuguggcacaagcgggaccuacggaacaggcuccuggcccgauggggccgaccugaaucuuaugccuauuuga

SEQ ID NO: 208581 - RNA, 1410 nt, Artificial Sequence
  derived and/or modified sequence opt5 from neuraminidase__InfluenzaA__AID70534
augaaccccaaucagaagaucauuaccaucggcagcgugucccugucuauuuacaucauuugcuucuuuaugcaaaucgccauccucauuacaacggucacccugcacuucaaacaguaugaguuuaacagcccuccgaauaaccaggcuaugcccugugaaccuacaaucauugagagaaauaucaccgaaauuguuuaccuuacaaacaccacaaucgagaaggaaauuugccccaaacuggccgaguaucggaauugguccaagccucagugugacaucaccggguucgcgcccuuuucuaaagauaacagcauccgccucuccgcuggaggcgacauuugggugacgagagagccuuacgugucuugcgauccggacaaguguuaucaauucgcccuggggcagggaaccacacuuaauaacguccauagcaauaacaccgugcgggaucgcacacccuacagaacccugcucaugaaugaacugggcguuccuuuucaccuggggacgaaacaggugugcaucgccugguccucuagcuccugucaugacggaaaggcuuggcuccacgucugcauuacaggcgaugacaagaacgccaccgcuagcuucaucuauaauggccggcugguggauucuguuguguccuggagcaaagagauucuucgcacacaggaaucugagugugucugcaucaacgggaccuguaccguggugaugacagacggauccgccagcggcaaggcggauacgaaaauccuguuuauugaggaagggaagaucguccauaccuccacacucucuggaagcgcccaacacguugaggaaugcuccugcuaccccagauacccuggcgugcggugugugugccgcgacaacuggaaggggagcaauagacccauugucgauaucaacauuaaagaccacucuaucguguccagcuauguuuguucuggacuggugggcgacaccccgcggaagaaugauagcuccucuagcucccauugccuugacccuaacaaugaggaaggcgggcacggagucaaaggcugggcuuucgaugacgggaacgauguguggaugggacgcacaaucaaugagaccagcagacugggcuacgagacguuuaagguuauugaaggguggucuaaccccaaauccaagcuccagaucaaucgccaggugauugucgaccggggaaacagaagcggcuauucuggcaucuucuccguggaggggaaaagcuguauuaaucggugcuuuuacgucgaacugaucagaggacgcaaggaggaaacagaggugcuguggaccuccaacucuauuguuguguucuguggcaccagcgggacauauggaaccggcuccuggccugauggggccgaccucaaucugaugcccaucuga

SEQ ID NO: 208582 - RNA, 1410 nt, Artificial Sequence
  derived and/or modified sequence opt5 from neuraminidase__InfluenzaA__AID70535
augaaccccaaucagaagaucauuaccaucggcagcgugucccuggccaugugcacaauuuguuucuuuaugcaaaucgcuauucucaucacgaccgucacacugcacuucaaacaguacgaguuuaacucuccuccgaauaaccaggccaugcccugcgaaccuaccaucauugagagaaauaucacagaaauuguuuaucuuaccaacacaaccaucgagaaggaaauuugucccaaacuggcggaguaccggaauuggagcaagccucagugcgacaucacgggguucgcucccuuuuccaaagauaacucuauucgccucagcgccggaggcgacaucugggugaccagagagccuuauguguccugugauccggacaagugcuaccaauucgcccuggggcagggaacaacccuuaauaacguccauucuaauaacacagugcgggaucgcacccccuauagaacgcugcucaugaaugaacugggcguuccuuuucaccuggggacaaaacagguguguaucgcuuggagcuccagcucuugccaugacggaaaggccuggcuccacgucuguauuaccggcgaugacaagaacgcuacagccuccuucaucuacaauggccggcugguggauagcguugugucuugguccaaagagauucuucgcacccaggaaagcgagugcgucuguaucaacgggaccugcacaguggugaugacggacggaucugcguccggcaaggccgauaccaaaauucuguuuaucgaggaagggaagaucguccauacaagcacccucuccggaucugcucaacacguugaggaaugcagcuguuaucccagauacccuggcgugcggugcgugugucgcgacaacuggaagggguccaauagacccauugucgauaucaacauuaaagaccacagcaucgugucuuccuacguuugcagcggacuggugggcgacacaccgcggaagaaugauucuagcuccucuagccauugucuugacccuaacaaugaggaaggcgggcacggagucaaaggcugggccuucgaugacgggaacgauguguggaugggacgcaccauuaaugagacguccagacugggcuaugagacauuuaagguuaucgaaggguggagcaaccccaaaucuaagcuccagaucaaucgccaggugauugucgaccggggaaacagauccggcuacagcggcaucuucucuguggaggggaaauccugcauuaaucgguguuuuuaugucgaacugaucagaggacgcaaggaggaaaccgaggugcuguggaccagcaacuccauuguuguguucugcggcacaucugggaccuacggaacaggcagcuggccugauggggcugaccucaaucugaugcccaucuga

SEQ ID NO: 208583 - RNA, 1410 nt, Artificial Sequence
  derived and/or modified sequence opt5 from neuraminidase__InfluenzaA__AID70536
augaaccccaaucagaagaucauuaccaucggcagcgugucccugacaauuucuacggucugcuucuuuaugcaaaucgccauucucaucaccacaguuacccugcacuucaaacaguacgaguuuaacagcccuccgaauaaccaggugaugcuuugugaacccacaaucauugacagaaauaucaccgagauuguguaucugacaaacaccacgaucgaaaaggagauuugcccuaaacucgcugaauaccggaauugguccaagccccagugugauaucaccggguucgccccuuuuucuaaagacaacagcauucgccuguccgcgggaggcgauaucugggucacaagagagcccuaugugucuugcgacccugauaaguguuaccaauucgcucuugggcagggaaccacacugaauaacguucauagcaauaacaccgugcgggaccgcacgccguauagaacacuccugaugaaugagcugggcguccccuuucaccucgggaccaaacaggugugcaucgccugguccucuagcuccugucaugauggaaaggccuggcugcacguuugcauuacaggcgacgauaagaacgcuaccgccagcuucaucuacaauggccggcuuguggacucugucguguccuggagcaaagaaauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccauuaaugaaacaagcagacucggcuaugagaccuuuaaggucaucgagggguggucuaacccuaaauccaagcugcagaucaaucgccaggugauugucgaucggggaaacagaagcggcuacucuggcaucuucuccguggaagggaaaagcuguauuaaucggugcuuuuauguugagcugaucagaggacgcaaggaagagaccgaagugcucuggacauccaacucuauugucguguucuguggcaccagcgggacauacggaacgggcuccuggcccgacggggcugaucugaaucuuaugccuaucuga

SEQ ID NO: 208584 - RNA, 1410 nt, Artificial Sequence; identical to SEQ ID NO: 202542
  derived and/or modified sequence opt5 from neuraminidase__InfluenzaA__AID70537

SEQ ID NO: 208585 - RNA, 1410 nt, Artificial Sequence
  derived and/or modified sequence opt5 from neuraminidase__InfluenzaA__AID70538
augaaccccaaucagaagaaaaucaccauuggcgccgugagccugacaaugugcacggucuguaucuucaugcaaauugcuauccucauuaccacaguuacccugcacuuuagacaguacgaguucaacuccccuccgaauaaccaggugaugcuuugcgaacccacaaucaucgagcggaauauuaccgaaaucguguaucugacaaacaccacgauugagaaggaaaucuguccuaaacucgccgaguaccgcaauuggucuaagccccagugcgacauuaccggguuugcgccuuucagcaaagauaacuccaucagacugucugcuggaggcgacauuugggucacacgggagcccuaugugagcugugauccugacaagugcuaccaauuugcccuugggcagggaaccacacugaauaacguucauuccaauaacaccgugcgcgauagaacgccguaucggacacuccugaugaaugaacugggcguccccuuccaccucgggaccaaacagguguguaucgccuggucuagcuccagcugccaugacggaaaggcuuggcugcacguuuguaucacaggcgaugacaagaacgccaccgcuucuuuuauuuacaauggccgccuuguggauuccgucgugagcuggucuaaagagauccugagaacccaggaauccgagugcguguguauuaacgggacaugcacggucguuaugaccgacggaagcgccucuggcaaggcggauacaaaaauccucuucauugaggaagggaagaucgugcauaccuccacacugagcggauccgcccaacacguggaggaaugcucuuguuauccucgguaccccggcguccgcugcguguguagagacaacuggaaggggagcaaucggccuaucguugauauuaacaucaaagaccacuccauugugagcucuuacgucugcuccggacuugugggcgacacgccccgcaagaaugauagcucuagcuccucucauugucuggacccgaacaaugaggaaggcgggcacggaguuaaaggcugggcuuuugaugacgggaacgauguguggaugggaagaaccaucaaugagacaagccggcucggcuaugagaccuucaaggucauugaagggugguccaacccuaaaagcaagcugcagaucaaucgccaggugaucgucgacagaggaaaccggucuggcuacuccggcauuuuuagcguggaggggaaaucuugcaucaauagauguuucuauguugaacugauucgcggacggaaggaggaaaccgaggugcucuggacauccaacagcaucgucguguuuugcggcaccuccgggacauacggaacgggcucuuggcccgauggggccgaccugaaucuuaugccuauuuga

SEQ ID NO: 208586 - RNA, 1410 nt, Artificial Sequence
  derived and/or modified sequence opt5 from neuraminidase__InfluenzaA__AID70539
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccugaacccgaauaacgaggaaggcgggcacggagugaaaggcugggccuucgacgaugggaaugacguuuggaugggacgcaccaucaacgagacaagcagacucggcuaugagaccuuuaaggugaucgaaggguggucuaauccuaaauccaagcugcagauuaaccggcaggucaucguggaucgcggaaauagaagcggcuacucuggcauuuucuccgucgaggggaaaagcuguaucaaccggugcuuuuauguggaacugauuagaggacgcaaggaggaaaccgagguucucuggacauccaauucuaucguggucuucuguggcaccagcgggacauacggaacgggcuccuggcccgacggggcugaucugaaccuuaugccuauuuga

SEQ ID NO: 208587 - RNA, 1410 nt, Artificial Sequence; identical to SEQ ID NO: 202542
  derived and/or modified sequence opt5 from neuraminidase__InfluenzaA__AID70540

SEQ ID NO: 208588 - RNA, 1410 nt, Artificial Sequence; identical to SEQ ID NO: 202542
  derived and/or modified sequence opt5 from neuraminidase__InfluenzaA__AID70541

SEQ ID NO: 208589 - RNA, 1410 nt, Artificial Sequence
  derived and/or modified sequence opt5 from neuraminidase__InfluenzaA__AID70633
augaaccccaaucagaagaucauuaccaucggcagcgugugcaugacaauugggauggccaaccugauccuccaaauuggaaauaucaucuccauuugggucucucacagcauccagcugggcaaccagucccagauugaggcuuguaaucaaucuguuaucacguacgaaaacaauaccugggugaaccagacauaugugaauauuagcaacaccaauuucgccgcggggcaguccgucgugucuguuaaacuugcuggaaacagcucccugugcccugugagcggcugggccaucuacucuaaggacaauuccgucagaauugggagcaaaggagauguguuuguuauccgggagccguucaucucuuguagcccccucgaaugccgcacauuuuuccugacccagggcgcccuucugaacgacaagcauuccaauggcacaauuaaagauagaucuccuuaucggacccucauguccugucccaucggggaggugccuagccccuacaacucccgcuuugaaucugucgcuuggagcgccuccgcuugccacgacggaauuaacuggcugacgaucggcauuagcgggccugauucuggagccguggcggugcugaaguauaauggcaucaucaccgacacaauuaaguccuggagaaacaauauccuccggacccaagagagcgagugugccugcgucaacgggucuuguuucacaauuaugaccgauggaccgagcgacggccaggcuuccuacaaaaucuuucgcauugaaaagggcaaaaucguuaagucuguggagaugaaugcccccaacuaucauuacgaagagugcagcuguuacccugauuccagcgagaucacgugcgugugcagagacaauuggcacgggucuaaccggcccugggucuccuucaaucagaaccuggaauaucagauuggauacaucuguagcggcguguuuggggauaauccucgccccaacgacaaaacaggaucuugcggcccgguuuccagcaauggggcuaacggagugaagggcuucuccuuuaaguauggcaauggggucuggauuggaagaaccaaaucuaucagcucccggaagggcuucgagaugauuugggauccuaacggguggacaggaaccgacaacaaauuuucuaucaagcaagacauugugggcaucaaugaauggagcggguacuccggcagcuucguucagcaucccgagcuuaccggacuggauuguauccgcccuugcuucuggguggaacucauuagaggccggcccgaggagaacacaaucuggacgucuggguccagcauuucuuuuuguggagucaauuccgacaccgugggcuggagcuggcccgauggggccgaacugccuuucacaaucgacaaauga

SEQ ID NO: 208590 - RNA, 1398 nt, Artificial Sequence
  derived and/or modified sequence opt5 from neuraminidase__InfluenzaA__AID70635
augaaccccaagcagaaaauccugugcaccagcgccacagcuauuaucauuggcgccaucgcggugcucauugggaucgcuaaucugggacuuaacaucggccugcaccucaagccuggguguaauugcucccauucucaaccggagacgaccaacacaagccagaccauuaucaauaacuacuauaaugaaacaaacauuaccaauauccagauggaggaaagaacaucccggaacuucaauaaccugaccaaaggacuuuguacgauuaauucuuggcacaucuacggcaaggacaacgccguccgcauuggggagagcuccgauguucuggugaccagagaacccuaugugucuugcgacccugaugagugucgguuuuacgcccucagccagggaacaaccauccgcggcaaacauuccaauggcacaauccacgacgggagccaauauagagcucugauuucuuggccccuguccagcccucccaccgucuacaacucucggguggagugcaucggaugguccagcacgucuugucaugauggcaagucccgcaugagcauuugcaucuccgggccuaacaauaacgccucugcuguugugugguauaauagacggccggucgccgaaauuaacacaugggcgcgcaauauccucagaacccaggagagcgaaugugugugccacaacggaguuugucccguggucuucacagacggcuccgccaccgggccugcugauacccggaucuacuacuuuaaggagggaaaaauucugaagugggagagccuuacaggcacggccaaacacaucgaagagugcucuugcuauggcgaacgcaccgggauuacauguaccugcagagacaauuggcagggauccaaccggcccgugauccagauugauccuguggcuaugacacauaccagccaauacaucuguucucccguccugacggacaauccgcgcccuaacgaucccaauaucggcaagugcaacgacccuuaucccgggaauaacaauaacggaguuaaaggcuucagcuaccucgauggggccaacacauggcugggaagaaccauuuccaccgcgucucggagcggcuaugagaugcuuaaggugcccaaugcccugacagacgacagauccaagccuauccagggccagaccauugugcucaacgcugauuggagcggguacucuggauccuuuauggacuauugggccgaaggcgauuguuaccgcgcuugcuucuacgucgagcugauccgggggagaccgaaagaggacaaggugugguggacaagcaauucuauuguuuccauguguagcuccacggaauuucugggacaguggaacuggcccgauggcgccaaaaucgaguauuuccucuga

SEQ ID NO: 208591 - RNA, 1401 nt, Artificial Sequence
  derived and/or modified sequence opt5 from neuraminidase__InfluenzaA__AIG44695
augaaccccaaucagaagaucaccgccauuggcagcgugucccugaucauugcuaucauuugccuccugaugcaaaucgccauccuuacaacgaccaugacacugcacuucagacagaacgaguguucuaauccuagcaacaaucaggucaugccgugcgaacccauuaucauugagcggaacaccguucaucucaauuccacaaccaucgaacgcgagauuuguccuaaaguggcggaauacaagaacuggucuaaaccccagugccaaaucacaggguuugcuccuuucagcaaggacaauuccauuagacugucugccagcggagauaucugggugacccgggagcccuaugucuccuguagccuugacaaaugcuaccaguuugcccugggccaggggacgacccucaagaacaagcacucuaauggaacaacccaugaucgcacaccucacagaacccugcugaugaacgagcucggcgugccguuccaucuggggacgaaacagguuuguaucgcuugguccuccucuuccugcuaugacggaaaggccuggcuucacgugugugucacaggcgaugacaaaaaugcuaccgccagcauuaucuacgauggcaugcugguggacucuguuggguccuggagcaagaacauucuccggacacaagaauccgagugcguguguaucaauggaaccugcgcggucgugaugaccgauggcucugccagcgggaaagcugacacacgcgugcuguuuauuagagaaggaaagaucaucaacauuagcccccuuagcggcucugcccagcacgucgaggagugcuccuguuauccucgguaccccgaaguucgcugcguguguagagauaacuggaaggggagcaaucggccuauccuguauauuaacauggcugacuacucuaucgagagcuccuacgugugcucuggacucgucggcgauacgccccgcaaugacgacagcuccucuagcuccaacuguagagauccgaauaacgaacggggcgccccuggggugaaaggaugggcguucgacgauggcaaugacguuuggauggggcgcaccauuaagaacggaagcagaucuggcuaugagacauuucggguggucaauggguggaccauggccaacuccaaaagccagaucaauagacaggugaucguugauuccgacggauggucuggcuacagcggcauuuucuccguggaagggaagaaaugcaucaaccgcuguuuuuaugucgagcugauucggggaagaccccaagagccucgcgugugguggacaucuaauagcaucauugucuucugcggcaccuccgggacguacggaacaggcagcuggcccgauggggcuaacaucaauuuuaugcccauuuga

SEQ ID NO: 208592 - RNA, 1410 nt, Artificial Sequence
  derived and/or modified sequence opt5 from neuraminidase__InfluenzaA__AIJ10793
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggcuaucgaaggguggucuaacccuaaauccaagcugcagaccaaucgccaggugauugucgaccggggaaacagaagcggcuacucuggcaucuucuccguggaggggaaaagcuguauuaaucggugcuuuuaugucgaacugaucagaggacgcaaggaggaaacagaggugcucuggaccuccaacucuauuguuguguucuguggcacaagcgggacguacggaaccggcuccuggcccgauggggccgaccugaaucuuaugccuaucuga

SEQ ID NO: 208593 - RNA, 1410 nt, Artificial Sequence; identical to SEQ ID NO: 202542
  derived and/or modified sequence opt5 from neuraminidase__InfluenzaA__AIJ10794

SEQ ID NO: 208594 - RNA, 1410 nt, Artificial Sequence; identical to SEQ ID NO: 204167
  derived and/or modified sequence opt5 from neuraminidase__InfluenzaA__AIJ10795

SEQ ID NO: 208595 - RNA, 1410 nt, Artificial Sequence; identical to SEQ ID NO: 204167
  derived and/or modified sequence opt5 from neuraminidase__InfluenzaA__AIJ10796

SEQ ID NO: 208596 - RNA, 1410 nt, Artificial Sequence
  derived and/or modified sequence opt5 from neuraminidase__InfluenzaA__AIJ10797
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucaaugagacaagccgccucggcuaugagaccuuuaaagugaucgaaggguggucuaacccuaaguccaaacugcagauuaauagacaggucaucguggaccggggaaaccgcagcggcuacucuggcauuuucuccgucgaggauaagagcuguaucaauagaugcuuuuauguggaacugauucgggggagaaaggaggaaaccgagguucucuggacauccaacucuaucguggucuucuguggaaccagcggcacauacgggacgggauccuggcccgacggcgcugaucugaaucuuaugccuauuuga

SEQ ID NO: 208597 - RNA, 1410 nt, Artificial Sequence
  derived and/or modified sequence opt5 from neuraminidase__InfluenzaA__AIJ10798
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuacccucgcugaguaccggaauugguccaaaccccagugugacauuacaggguucgccccuuuuucuaaggauaacagcauccgccuguccgcgggaggcgacaucugggugaccagagagcccuaugucucuugcgauccugacaaauguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcauugccugguccagcagcuccugucaugacggaaaggccuggcugcacgugugcaucaccggcgaugacaaaaacgcuaccgccagcuucauuuacaauggccggcuuguugauucuguggucuccuggagcaaggagauccugcgcacacaggaaucugagugugugugcauuaacgggacguguaccguggucaugacagacggauccgcuagcggcaaagccgauaccaagauccucuuuaucgaggaagggaaaauuguucauacauccacccugucuggaagcgcgcaacacguggaggaaugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcacaaucaaugagaccagcagacucggcuaugagaccuuuaaagugaucgaaggguggucuaacccuaaguccaaacugcagauuaaucggcaggucaucguggaccgcggaaacagaagcggcuacucuggcauuuucuccgucgaggggaagucuuguaucaaucggugcuuuuauguggaacugauuagaggacgcaaagaggaaacagagguucucuggaccuccaacucuaucguggucuucuguggcacaagcgggacguacggaaccggcuccuggcccgauggggcugaccugaaucuuaugccuauuuga

SEQ ID NO: 208598 - RNA, 1410 nt, Artificial Sequence; identical to SEQ ID NO: 204167
  derived and/or modified sequence opt5 from neuraminidase__InfluenzaA__AIJ10799

SEQ ID NO: 208599 - RNA, 1410 nt, Artificial Sequence
  derived and/or modified sequence opt5 from neuraminidase__InfluenzaA__AIJ10800
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggcaaacuuguugauuccguggucagcuggucuaaggagauccugcggacccaggaauccgagugugugugcauuaacgggacauguacgguggucaugaccgacggaagcgcuuccggcaaagccgauacaaagauccucuuuaucgaggaagggaagauuguucauaccucuacacugagcggauccgcgcaacacguggaggaaugcagcugcuauccccgcuacccuggcgugagaugugucugccgggacaacuggaaagggucuaaucgccccaucguggauauuaacaucaaggaccacuccauuguuagcucuuacguguguagcggacuugucggcgacaccccuagaaagaaugauuccucuagcuccagccauugccuggaccccaacaaugaggaaggcgggcacggagugaagggcugggccuucgaugacgggaacgauguuuggaugggacggacgaucaaugagacaucucgccucggcuaugagaccuuuaaagugaucgaagggugguccaacccgaaaagcaaacugcagauuaauagacaggucaucguggaccggggaaaccgcucuggcuacuccggcauuuucagcgucgaggggaaguccuguaucaauagaugcuuuuauguggaacugauucggggaagaaaggaggaaaccgagguucucuggacaucuaacagcaucguggucuucuguggcaccuccgggacauacggaacgggcucuuggccugauggggcugaccugaaucuuaugcccauuuga

SEQ ID NO: 208600 - RNA, 1410 nt, Artificial Sequence; identical to SEQ ID NO: 205170
  derived and/or modified sequence opt5 from neuraminidase__InfluenzaA__AIJ10801

SEQ ID NO: 208601 - RNA, 1410 nt, Artificial Sequence; identical to SEQ ID NO: 205170
  derived and/or modified sequence opt5 from neuraminidase__InfluenzaA__AIJ10803

SEQ ID NO: 208602 - RNA, 1410 nt, Artificial Sequence; identical to SEQ ID NO: 205170
  derived and/or modified sequence opt5 from neuraminidase__InfluenzaA__AIJ10804

SEQ ID NO: 208603 - RNA, 1410 nt, Artificial Sequence; identical to SEQ ID NO: 205170
  derived and/or modified sequence opt5 from neuraminidase__InfluenzaA__AIJ10805

SEQ ID NO: 208604 - RNA, 1410 nt, Artificial Sequence
  derived and/or modified sequence opt5 from neuraminidase__InfluenzaA__AIJ10806
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuaucagccauugccuugauccuaacaaugaggaagggggacacggcgugaaagggugggccuucgacgauggaaacgacguuuggaugggccgcacgaucaaugagacauccagacugggguaugagaccuuuaaggugauugaaggauggagcaaccccaaaucuaagcuccagaucaaucggcaggucauuguggaucgcggcgacagauccggcuacagcgggaucuucucugucgagggaaaauccuguauuaaccggugcuuuuauguggaacugaucagaggccgcaaggaggaaaccgagguucuguggacaagcaauuccauuguggucuucugugggaccucuggaacauacggcacggggagcuggccugauggcgcugaccucaaccugaugcccaucuga

SEQ ID NO: 208605 - RNA, 1410 nt, Artificial Sequence
  derived and/or modified sequence opt5 from neuraminidase__InfluenzaA__AIJ10807
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagaggcuuaugucucuugcgacccugauaaguguuaccaauucgcccugggacagggcaccacacuuaauaacgugcauagcaauaacaccguucgggaccgcacgccguauagaacacugcucaugaaugaacugggggugcccuuucaccugggaaccaagcaggucugcauugccugguccucuagcuccugucaugauggcaaggcuuggcuccacgugugcaucacaggcgacgauaaaaacgccaccgcuagcuucauuuacaaugggcggcugguugacucuguggucuccuggagcaaagagauccuucgcacccaggaaucugagugugugugcauuaacggaacauguacgguggucaugaccgauggcuccgccagcgggaaggcggacacaaaaauccuguuuaucgaggaaggaaagauuguucauaccuccacacucucuggcagcgcccaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuggucggcgacacgccccggaagaaugacagcuccucuagcucccauugccuugauccgaacaaugaggaagggggacacggcgugaaagggugggcuuucgacgauggaaacgacguuuggaugggccgcaccaucaaugagacaagcagacugggguaugagaccuuuaaggugaucgaaggauggucuaacccuaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggcccgauggcgccgaccucaaccugaugccuauuuga

SEQ ID NO: 208606 - RNA, 1410 nt, Artificial Sequence
  derived and/or modified sequence opt5 from neuraminidase__InfluenzaA__AIJ10808
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagaggugcuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 208607 - RNA, 1410 nt, Artificial Sequence; identical to SEQ ID NO: 205170
  derived and/or modified sequence opt5 from neuraminidase__InfluenzaA__AIJ10809

SEQ ID NO: 208608 - RNA, 1410 nt, Artificial Sequence; identical to SEQ ID NO: 205170
  derived and/or modified sequence opt5 from neuraminidase__InfluenzaA__AIJ10810

SEQ ID NO: 208609 - RNA, 1410 nt, Artificial Sequence
  derived and/or modified sequence opt5 from neuraminidase__InfluenzaA__AIJ10812
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuauggagagaaaugugaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauauuugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcaucacaggcgacgauaagaacgcuaccgccagcuucauuuacaaugggcggcugguggacucugucguguccuggagcaaagagauccuucgcacccaggaaucugagugugugugcauuaacggaacauguacggucguuaugaccgauggcuccgcuagcgggaaggccgacacaaaaauccuguuuauugaggaaggaaagaucgugcauaccuccacacucucuggcagcgcgcaacacguggaggaaugcuccugcuaucccagauacccugggguccggugugugugccgcgauaacuggaagggaagcaauagacccaucguugacauuaacaucaaagaucacucuauuguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgaucaaugagacaagcagacugggguaugagaccuuuaaggucauugaaggauggucuaaccccaaauccaagcuccagaucaaucgccaggugaucgucgaucggggcgacagaagcggcuacucugggauuuucuccguggagggaaaaagcuguaucaaccggugcuuuuauguugaacugauuagaggccgcaaggaggaaaccgaggugcuguggacauccaauucuaucgucguguucugugggaccagcggaacauacggcacgggguccuggccugauggcgcugaccucaaccugaugcccauuuga

SEQ ID NO: 208610 - RNA, 1410 nt, Artificial Sequence
  derived and/or modified sequence opt5 from neuraminidase__InfluenzaA__AIJ10813
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuauggagagaaaugugaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauauuugggucacaagagagccuuaugugucuugcgacccggauaaguguuaccaauucgcucugggacagggcaccacacuuaauaacguucauagcaauaaccccgugcgggaccgcaccccuuauagaacgcugcucaugaaugaacuggggguccccuuucaccugggaacaaaacaggugugcaucgccugguccucuagcuccugucaugauggcaaggccuggcuccacguuugcaucaccggcgacgauaagaacgcuacagccagcuucauuuacaaugggcggcugguggacucugucguguccuggagcaaagagauccuucgcacccaggaaucugagugugugugcauuaacggaaccuguacagucguuaugacggauggcuccgcuagcgggaaggccgacaccaaaauccuguuuauugaggaaggaaagaucgugcauacauccacccucucuggcagcgcgcaacacguggaggaaugcuccugcuauccuagauaccccgggguccggugugugugccgcgauaacuggaagggaagcaauagaccgaucguugacauuaacaucaaagaucacucuauuguguccagcuacgucuguucuggccuggugggcgacacaccucggaagaaugacagcuccucuagcucccauugccuugaucccaacaaugaggaagggggacacggcguuaaagggugggccuucgacgauggaaacgacguguggaugggccgcaccaucaaugagacgagcagacugggguaugagacauuuaaggucauugaaggauggucuaacccuaaauccaagcuccagaucaaucgccaggugaucgucgaucggggcgacagaagcggcuacucugggauuuucuccguggagggaaaaagcuguaucaaccggugcuuuuauguugaacugauuagaggccgcaaggaggaaaccgaggugcuguggaccuccaauucuaucgucguguucugugggacaagcggaaccuacggcacaggguccuggcccgauggcgcugaccucaaccugaugcccauuuga

SEQ ID NO: 208611 - RNA, 1410 nt, Artificial Sequence
  derived and/or modified sequence opt5 from neuraminidase__InfluenzaA__AIJ10814
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuguggagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaaucgccaggugauugucgauaaaggcgaccggagcggcuacucugggaucuucuccguggagggaaagagcuguauuaacagaugcuuuuauguugaacugauccggggcagaaaggaggaaaccgaggugcuguggacauccaauucuauugucguguucugugggaccagcggaacauacggcacgggguccuggccugauggcgcugaccucaaccugaugcccaucuga

SEQ ID NO: 208612 - RNA, 1410 nt, Artificial Sequence
  derived and/or modified sequence opt5 from neuraminidase__InfluenzaA__AIJ10815
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaaugagguucuguggaccuccaacucuaucguggucuucugugggacaagcggaaccuacggcacaggguccuggccugauggcgcugaccucaaucugaugcccauuuga

SEQ ID NO: 208613 - RNA, 1410 nt, Artificial Sequence
  derived and/or modified sequence opt5 from neuraminidase__InfluenzaA__AIJ10816
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaggcuguaucaaccggugcuuuuauguggaacugauuagagggcgcaaggaggaaaccgagguucuguggacaagcaauuccaucguggucuucuguggaaccucuggcacauacgggacgggcagcuggccugauggagcugaccucaaccugaugcccauuuga

SEQ ID NO: 208614 - RNA, 1410 nt, Artificial Sequence; identical to SEQ ID NO: 205170
  derived and/or modified sequence opt5 from neuraminidase__InfluenzaA__AIJ10817

SEQ ID NO: 208615 - RNA, 1410 nt, Artificial Sequence; identical to SEQ ID NO: 205170
  derived and/or modified sequence opt5 from neuraminidase__InfluenzaA__AIJ10818

SEQ ID NO: 208616 - RNA, 1410 nt, Artificial Sequence
  derived and/or modified sequence opt5 from neuraminidase__InfluenzaA__AIJ10819
augaaccccaaucagaagaucauuaccaucggcagcgugucccugacaauuucuacgaucugcuucuuuaugcaaauugccauccucaucaccacagucgcucugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacccgccgaguaccggaauugguccaagccucagugugggauuacgggauucgcgcccuuuucuaaagacaacagcauccgccucuccgcuggcggggauaucugggugaccagagagccuuaugucucuugcgacccggauaaguguuaccaauucgcccugggacagggcacaacccuuaauaacgugcauagcaauaacacaguucgggaccgcacccccuauagaacgcugcucaugaaugaacugggggugccuuuucaccugggaacaaagcaggucugcauugccugguccucuagcuccugucaugauggcaaggcuuggcuccacgugugcaucaccggcgacgauaaaaacgccacagcuagcuucauuuacaaugggcggcugguugacucuguggucuccuggagcaaagagauccuucgcacccaggaaucugagugugugugcauuaacggaaccuguacaguggucaugacggauggcuccgccagcgggaaggcgaacaccaaaauccuguuuaucgaggaaggaaagauuguucauacauccacccucucuggcagcgcccaacacguggaggaaugcuccugcuaucccagauacccuggggugcggugugucugccgcgacaauuggaagggaagcaacagacccaucguggauauuaauaucaaagaccacucuauuguuuccagcuacguguguucuggccuggucggcgauacaccgcggaagaacgacagcuccucuagcucccauugccuugacccuaauaacgaggaagggggacacggcgugaaagggugggcuuucgaugacggaaaugauguuuggaugggccgcaccaucaacgagacgagcagacugggguaugagacauuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggaccuccaacucuaucguggucuucugugggacaagcggaaccuacggcacaggguccuggccugacggcgccgaucucaaucugaugcccauuuga

SEQ ID NO: 208617 - RNA, 1410 nt, Artificial Sequence; identical to SEQ ID NO: 205170
  derived and/or modified sequence opt5 from neuraminidase__InfluenzaA__AIJ10820

SEQ ID NO: 208618 - RNA, 1410 nt, Artificial Sequence; identical to SEQ ID NO: 205170
  derived and/or modified sequence opt5 from neuraminidase__InfluenzaA__AIJ10821

SEQ ID NO: 208619 - RNA, 1410 nt, Artificial Sequence
  derived and/or modified sequence opt5 from neuraminidase__InfluenzaA__AIJ10822
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagauuaaucggcaggucaucguggaccgcggcgauagaagcggcuacucugggauuuucuccgucgaaggaaaaagcuguaucaaccggugcuuuuauguggagcugauuagaggccgcaaggaagagaaugaaguucuguggaccuccaacucuaucguggucuucugugggacaagcggaaccuacggcacaggguccuggccugacggcgcugaucucaaucugaugcccauuuga

SEQ ID NO: 208620 - RNA, 1410 nt, Artificial Sequence
  derived and/or modified sequence opt5 from neuraminidase__InfluenzaA__AIJ10823
augaaccccaaucagaagaucauuaccaucggcagcgugucccugacaauuucuacgaucugcuucuuuaugcaaauugccauccucaucaccacagucacccugcacuucaaccaguacgaguuuaauagcccuccgaacaaucagguuaugcuuugugaacccacaauuaucgagagaaacauuaccgaaaucguguaucugacaaccacgaccauugagaaagaaaucugcccuaagcccgcugaguaccggaauugguccaaaccucagugugggauuacaggauucgcccccuuuucuaaggacaacagcauccgccucuccgcgggcggggauaucugggugaccagagagccuuaugucucuugcgacccggauaaauguuaccaauucgcucugggacagggcacaacccuuaauaacgugcauagcaauaacacgguucgggaccgcacacccuuuagaacccugcucaugaaugaacugggggugccuuuccaccugggaacaaagcaggucugcauugccugguccucuucuuccugucaugauggcaaggccuggcuccacgugugcaucaccggcgacgauaaaaacgcuaccgccagcuuuauuuauaaugggcggcugguugacucuguggucuccuggagcaaggagauccuucgcacacaggaaucugagugugugugcauuaacggaacguguaccguggucaugacagauggcuccgcuagcgggaaagccguuaccaagauccuguucaucgaggaaggaaaaauugugcauacauccacccucucuggcagcgcgcaacacguggaggaaugcuccugcuaccccagauauccugggguccggugugugugccgcgacaacuggaagggaagcaauagacccaucguugauauuaacaucaaggaccacucuauuguguccggcuacgucuguagcggccuggugggggauacgccgcggaaaaaugacucuagcuccucuagccauugccuuaacccuaauaacgaggaaggaggccacgggguuaagggaugggccuuugacgauggcaaugacguguggauggggcgcacaaucaacgagaccuccagacugggauacgagaccuucaaagucaucgaaggcuggagcaaucccaagucuaaacuccagauuaaccgccaggugaucgucgaucggggcgacagauccggguauagcggaauuuuuagcguggagggcaaguccuguaucaaucggugcuucuacguugaacugauuagagggcgcaaagaggaaacagaggugcuguggaccagcaacuccaucgucguguucuguggaacaucuggcacguaugggaccggcagcuggccugauggagcugaccucaaucugaugcccauuuga

SEQ ID NO: 208621 - RNA, 1410 nt, Artificial Sequence
  derived and/or modified sequence opt5 from neuraminidase__InfluenzaA__AIJ10824
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcauugccugguccucuagcuccugucaugauggcaaggccuggcuccacguuugcaucacaggcgacgauaagaacgcuaccgccagcuucauuuacaaugggcggcugguggacucugucguguccuggagcaaagagauccuucgcacccaggaaucugagugugugugcauuaacggaacauguacggucguuaugaccgauggcuccgcuagcgggaaggccgacacaaaaauccuguuuaucgaggaaggaaagauugugcauaccuccacacucucuggcagcgcgcaacacguggaggaaugcuccugcuaucccagauacccugggguccggugugugugccgcgauaacuggaagggaagcaauagacccaucguugacauuaacaucaaagaucacucuauuguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgaucaaugagacaagcagacugggguaugagaccuuuaaggucaucgaaggauggucuaaccccaaauccaagcuccagauuaaucgccaggugaucgucgaucggggcgacagaagcggcuacucugggauuuucuccguggagggaaaaagcuguaucaaccggugcuuuuauguugaacugauuagaggccgcaaggaggaaaccgaggugcuguggacauccaauucuaucgucguguucugugggaccagcggaacauacggcacgggguccuggccugauggcgcugaccucaaccugaugcccauuuga

SEQ ID NO: 208622 - RNA, 1410 nt, Artificial Sequence
  derived and/or modified sequence opt5 from neuraminidase__InfluenzaA__AIJ10827
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagauuaaucggcaggucaucguggaccgcggcgauagaagcggcuacucugggauuuucuccaucgaaggaaaaagcuguauuaaccggugcuuuuaugucgagcugaucagaggccgcaaggaagagaccgaagugcuguggacauccaauucuauuguuguguucugugggaccagcggaacauacggcacgggguccuggccugacggcgcugaucucaaccugaugcccaucuga

SEQ ID NO: 208623 - RNA, 1410 nt, Artificial Sequence
  derived and/or modified sequence opt5 from neuraminidase__InfluenzaA__AIJ10828
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagauuaaucggcaggucaucguggaccgcggcgauagaagcggcuacucugggauuuucuccaucgaaggaaaaagcuguauuaaccggugcuuuuaugucgagcugaucagaggccgcaaggaagagaccgaagugguuuggacauccaauucuauuguggucuucugugggaccagcggaacauacggcacgggguccuggccugacggcgcugaucugaaccucaugcccaucuga

SEQ ID NO: 208624 - RNA, 1410 nt, Artificial Sequence
  derived and/or modified sequence opt5 from neuraminidase__InfluenzaA__AIJ10829
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaauuguuaccaauucgcucugggacagggcaccacacuuaacaaugugcauagcaacaauaccguucgggaccgcacgcccuauagaacacugcucaugaacgaacugggggugccuuuucaccugggaaccaagcaggucugcauugccugguccagcagcuccugucaugauggcaaggccuggcuccacgugugcaucacaggcgacgauaaaaaugcuaccgccagcuucauuuacaacgggcggcugguugacucuguggucuccuggagcaaggauauccuucgcacccaggagucugaaugugugugcauuaacggaacauguacgguggucaugaccgacggcuccgcuagcgggaaagccgauacaaagauccuguuuaucgaggagggaaaaauuguucauaccuccacacucucuggcagcgcgcaacacguggaagagugcuccugcuaucccagauacccuggggugcggugugucugccgcgacaauuggaagggaagcaacagacccaucguggauauuaauaucaaggaccacucuauuguuuccagcuacguguguucuggccuggucggcgacaccccgcggaaaaacgauagcuccucuagcucccauugccuugacccuaauaacgaagagggggaucacggagugaagggcugggccuucgacgaugggaaugacguuuggaugggacgcacgaucaacgaaacaagcagacugggcuaugagaccuuuaaagugaucgagggguggucuaaucccaaguccaaacuccagauuaaccggcaggucaucguggaucgcggagacagaagcggcuacucuggcauuuucuccaucgaagggaagucuuguauuaaucggugcuuuuaugucgagcugaucagaggacgcaaagaagagaccgaagugcuguggacauccaacucuauuguuguguucuguggcaccagcgggacauacggaacgggcuccuggccugauggggcugaccucaaucugaugcccaucuga

SEQ ID NO: 208625 - RNA, 1410 nt, Artificial Sequence
  derived and/or modified sequence opt5 from neuraminidase__InfluenzaA__AIJ10830
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguacaagaauugguccaaaccucagugugggauuaccggauucgcccccuuuucuaaggacaacagcauccggcucuccgcgggcggggauaucugggugacacgcgagccuuaugucucuugcgacccggauaaguguuaccaauucgcucugggacagggcaccacacuuaauaacgugcauagcaauaacaccguuagagaccggacgcccuaucgcacacugcucaugaaugaacugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggagacugguugacucuguggucuccuggagcaaggauauccuucggacccaggagucugaaugugugugcauuaacggaacauguacgguggucaugaccgacggcuccgcuagcgggaaagccgauacaaagauccuguuuaucgaggagggaaagauuguucauaccuccacacucucuggcagcgcgcaacacguggaagagugcuccugcuauccccgcuacccuggggugagaugugucugccgggacaacuggaaaggaagcaaucgccccaucguggauauuaacaucaaggaccacucuauuguuuccagcuacguguguucuggccuggucggcgacaccccgcggaaaaaugauagcuccucuagcucccauugccuugacccuaacaaugaagaagggggacacggcgugaaggggugggccuucgaugacggaaacgauguuuggaugggcagaacgaucaaugagacaagccgccugggguaugagaccuuuaaagugaucgagggauggucuaaccccaaguccaaacuccagauuaauagacaggucaucguggaccggggcgaucgcagcggcuacucugggauuuucuccaucgaaggaaagagcuguauuaacagaugcuuuuaugucgagcugauccggggcagaaaggaagagaccgaagugcuguggacauccaauucuauuguuguguucugugggaccagcggaacauacggcacgggguccuggccugacggcgcugaucucaaccugaugcccaucuga

SEQ ID NO: 208626 - RNA, 1410 nt, Artificial Sequence; identical to SEQ ID NO: 208622
  derived and/or modified sequence opt5 from neuraminidase__InfluenzaA__AIJ10831

SEQ ID NO: 208627 - RNA, 1410 nt, Artificial Sequence; identical to SEQ ID NO: 208622
  derived and/or modified sequence opt5 from neuraminidase__InfluenzaA__AIJ10832

SEQ ID NO: 208628 - RNA, 1410 nt, Artificial Sequence
  derived and/or modified sequence opt5 from neuraminidase__InfluenzaA__AIJ10834
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagauuaaucggcaggucaucguggaccgcggcgauagaagcggcuacucugggauuuucuccaucgaaagcaaauccuguauuaaccggugcuuuuaugucgagcugaucagaggacgcaaggaagagaccgaagugcuguggacaucuaauagcauuguuguguucuguggcaccuccgggacauacggaacgggcucuuggccugacggggcugaucucaaccugaugcccaucuga

SEQ ID NO: 208629 - RNA, 1410 nt, Artificial Sequence
  derived and/or modified sequence opt5 from neuraminidase__InfluenzaA__AIJ10835
augaaccccaaucagaagaucauuaccaucggcagcgugucccugacaauuucuacgaucugcuucuuuaugcaaauugccauccucaucaccacagucacccugcacuucaaacaguacgaguuuaacagcacaccuaauaaccagguuaugcuuugugaaccgaccauuaucgagagaaauauuacagaaaucguguaucugaccaacacgaccauugagaaggaaaucugccccaaaccugcugaguaccggaauugguccaagccccagugugggauuacaggauucgccccuuuuucuaaagacaacagcauccgccucuccgcgggcggggauaucugggugaccagagagcccuaugucucuugcgacccugauaaguguuaccaauucgcucugggacagggcacaacccuuaauaacgugcauagcaauaacacgguucgggaccgcacaccguauagaacccugcucaugaaugaacugggggugcccuuucaccugggaacaaagcaggucugcauugccugguccucuagcuccugucaugauggcaaagccuggcuccacgugugcaucaccggcgacgauaagaacgcuaccgccagcuucauuuacaaugggcggcugguugacucuguggucuccuggagcaaagauauccuucgcacacaggagucugaaugugugugcauuaacggaacguguaccguggucaugacagacggcuccgcuagcgggaaggccgauaccaaaauccuguuuaucgaggagggaaagauuguucauacauccacccucucuggcagcgcgcaacacguggaagagugcuccugcuauccuagauaccccggggugcggugugucugccgcgacaacuggaagggaagcaauagaccuaucguggauauuaacaucaaagaccacucuauuguuuccagcuacguguguucuggccuggucggcgacacgccccggaagaaugauagcuccucuagcucccauugccuugacccgaacaaugaagaagggggacacggcgugaaagggugggccuucgaugacggaaacgauguuuggaugggccgcacaaucaaugagaccagcagacugggguaugagaccuuuaaggugaucgagggauggucuaacccuaaauccaagcuccagauuaaucggcaggucaucguggaccgcggcgauagaagcggcuacucugggauuuucuccaucgaaggaaaaagcuguauuaaccggugcuuuuaugucgagcugaucagaggccgcaaggaagagacagaagugcuguggaccuccaauucuauuguuguguucugugggacaagcggaacguacggcaccggguccuggcccgacggcgcugaucucaaccugaugccuaucuga

SEQ ID NO: 208630 - RNA, 1410 nt, Artificial Sequence; identical to SEQ ID NO: 208622
  derived and/or modified sequence opt5 from neuraminidase__InfluenzaA__AIJ10836

SEQ ID NO: 208631 - RNA, 1410 nt, Artificial Sequence
  derived and/or modified sequence opt5 from neuraminidase__InfluenzaA__AIJ10837
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuauccauaccuccacacucucuggcagcgcgcaacacguugaagagugcuccugcuaucccagauacccuggggugcggugugugugccgcgacaacuggaagggaagcaauagacccauugucgauaucaacauuaaagaccacucuaucguguccagcuacguuuguucuggccuggugggcgacaccccgcggaagaaugauagcuccucuagcucccauugccuugacccuaacaaugaagaagggggacacggcgucaaagggugggccuucgaugacggaaacgauguguggaugggccgcacgaucaaugagacaagcagacugggguaugagaccuuuaagguuauugagggauggucuaaccccaaauccaagcuccagaucaaucgccaggugauugucgaccggggcgauagaagcggcuacucugggaucuucuccauugaaggaaaaagcuguaucaaccggugcuuuuauguggagcugauuagaggccgcaaggaagagaccgaaguccuguggacauccaauucuaucgugguuuucugugggaccagcggaacauacggcacgggguccuggccugacggcgcugaucucaaccugaugcccaucuga

SEQ ID NO: 208632 - RNA, 1410 nt, Artificial Sequence; identical to SEQ ID NO: 208622
  derived and/or modified sequence opt5 from neuraminidase__InfluenzaA__AIJ10838

SEQ ID NO: 208633 - RNA, 1410 nt, Artificial Sequence
  derived and/or modified sequence opt5 from neuraminidase__InfluenzaA__AIJ10841
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcggggaggccgauacaaagauccuguuuaucgaggaaggaaaaauuguucauaccuccacacucucuggcagcgcgcaacacguggaggaaugcuccugcuaucccagauacccuggggugcggugugucugccgcgacaacuggaagggaagcaauagacccaucguggauauuaacaucaaggaccacucuauuguuuccagcuacguguguucuggccuggucggcgacaccccgcggaaaaaugauagcuccucuagcucccauugccuugacccuaacaaugaggaagggggacacggcgugaaggggugggccuucgaugacggaaacgauguuuggaugggccgcacgaucaaugagacaagcagacugggguaugagaccuuuaaagugaucgaaggauggucuaaccccaaguccaaacuccagauuaaucggcaggucaucguggaccgcggcgauagaagcggcuacucugggauuuucuccaucgagggaaagagcuguauuaaccggugcuuuuaugucgaacugaucagaggccgcaaagaggaaaccgaggugcuguggacauccaauucuauuguuguguucugugggaccagcggaacauacggcacgggguccuggccugacggcgcugaucucaaccugaugcccaucuga

SEQ ID NO: 208634 - RNA, 1410 nt, Artificial Sequence
  derived and/or modified sequence opt5 from neuraminidase__InfluenzaA__AIJ10842
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaaccugcugaguaccggaauuggagcaagccccagugugggauuaccggauucgccccuuuuuccaaagacaacucuauccgccucagcgcgggcggggauaucugggugacaagagagccguaugucuccugcgaccccgauaaguguuaccaauucgcucugggacagggcaccacacuuaauaacgugcauucuaauaacaccguucgggaccgcacgccuuauagaacacugcucaugaaugaacugggggugcccuuucaccugggaaccaagcaggucugcauugccuggagcuccagcucuugucaugauggcaaagccuggcuccacgugugcaucacaggcgacgauaagaacgcuaccgccuccuucauuuacaaugggcggcugguugacagcguggucucuugguccaaagauauccuucgcacccaggagagcgaaugugugugcauuaacggaacauguacgguggucaugaccgacggcucugcuuccgggaaggccgauacaaaaauccuguuuaucgaggagggaaagauuguucauaccagcacacucuccggcucugcgcaacacguggaagagugcagcugcuauccuagauaccccggggugcggugugucugccgcgacaacuggaagggauccaauagaccgaucguggauauuaacaucaaagaccacagcauuguuucuuccuacguguguagcggccuggucggcgacaccccucggaagaaugauucuagcuccucuagccauugccuugaccccaacaaugaagaagggggacacggcgugaaagggugggccuucgaugacggaaacgauguuuggaugggccgcacgaucaaugagacauccagacugggguaugagaccuuuaaggugaucgagggauggagcaacccuaaaucuaagcuccagauuaaucggcaggucaucguggaccgcggcgauagauccggcuacagcgggauuuucucuaucgaaggaaaauccuguauuaaccggugcuuuuaugucgagcugaucagaggccgcaaggaagagaccgaagugcuguggacaagcaauuccauuguuguguucugugggaccucuggaacauacggcacggggagcuggcccgacggcgcugaucucaaccugaugcccaucuga

SEQ ID NO: 208635 - RNA, 1410 nt, Artificial Sequence; identical to SEQ ID NO: 208622
  derived and/or modified sequence opt5 from neuraminidase__InfluenzaA__AIJ10843

SEQ ID NO: 208636 - RNA, 1410 nt, Artificial Sequence
  derived and/or modified sequence opt5 from neuraminidase__InfluenzaA__AIJ10844
augaaccccaaucagaagaucauuaccaucggcagcgugucccugacaauuucuacgaucugcuucuuuaugcagauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuuuagaacacugcucaugaaugaacugggggugccuuuccaccugggaaccaagcaggucugcauugccugguccucuagcuccugucaugauggcaaagccuggcuccacgugugcaucacaggcgacgauaagaacgcuaccgccagcuuuauuuauaaugggcggcugguugacucuguggucuccuggagcaaagagauccuucgcacccaggaaucugagugugugugcauuaacggaacauguacgguggucaugaccgauggcuccgcuagcgggaaggccguuacaaaaauccuguucaucgaggaaggaaagauugugcauaccuccacacucucuggcagcgcgcaacacguggaggaaugcuccugcuaccccagauauccugggguccggugugugugccgcgacaacuggaagggaagcaauagacccaucguugauauuaacaucaaagaccacucuauuguguccggcuacgucuguagcggccuggugggggauaccccgcggaagaaugacucuagcuccucuggacauugccuugacccuaacaaugaggaaggcgggcacggaguuaaaggcugggccuuugaugacgggaacgauguguggaugggacgcacgaucaaugagacaagcagacugggcuacgagaccuucaaggucaucaaaggcugguccaaccccaagagcaaacuccagauuaaucggcaagugaucgucgaccgcggggauagaucuggauauuccggcauuuuuagcguggaagggaagucuuguaucaaccggugcuucuacguugagcugauuagaggacgcaaggaagagaccgaagugcuguggacauccaauagcaucgucguguucuguggcaccuccgggacauauggcacgggaucuuggccugacggcgcugaucucaaccugaugcccauuuga

SEQ ID NO: 208637 - RNA, 1410 nt, Artificial Sequence
  derived and/or modified sequence opt5 from neuraminidase__InfluenzaA__AIJ10845
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccauuaucgagaaggaaauuugcccuaaacccgcugaguaccggaauugguccaagccucagugugggaucacgggauucgcccccuuuucuaaagacaacagcauccgccucuccgcgggcggggauauuugggugaccagagagccuuaugucucuugcgacccggauaaguguuaccaauucgcucugggacagggcacaacccuuaauaacgugcauagcaauaacacaguucgggaccgcacccccuuuagaacgcugcucaugaaugaacugggggugccuuuccaccugggaacaaagcaggucugcaucgccugguccucuagcuccugucaugauggcaaagccuggcuccacgugugcauuaccggcgacgauaagaacgcuacagccagcuuuaucuauaaugggcggcugguugacucuguggucuccuggagcaaagagauucuucgcacccaggaaucugagugugugugcaucaacggaaccuguacaguggucaugacggauggcuccgcuagcgggaaggccguuaccaaaauccuguucauugaggaaggaaagaucgugcauacauccacccucucuggcagcgcgcaacacguggaggaaugcuccugcuaccccagauauccugggguccggugugugugccgcgacaacuggaagggaagcaauagacccauuguugauaucaacauuaaagaccacucuaucguguccggcuacgucuguagcggccuggugggggauacaccgcggaagaaugacucuagcuccucuagccauugccuugacccuaacaaugaggaaggaggccacgggguuaaaggaugggccuuugaugacggcaacgauguguggauggggcgcaccaucaaugagacguccagacugggauacgagacauucaaggucauugaaggcuggagcaaccccaaaucuaagcuccagaucaaucgccaggugauugucgaccggggcgauagauccggguauagcggaaucuuuucuguggagggcaaauccuguauuaaccggugcuucuacguugaacugaucagagggcgcaaggaggaaaccgaggugcuguggaccagcaauuccauugucguguucuguggaacaucuggcaccuaugggacaggcagcuggccugacggagcugaucucaaccugaugcccaucuga

SEQ ID NO: 208638 - RNA, 1410 nt, Artificial Sequence
  derived and/or modified sequence opt5 from neuraminidase__InfluenzaA__AIJ10847
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuucuuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuucuccucuagccauugccuugacccuaacaaugaagaagggggacacggcgugaaagggugggccuuugaugacggaaacgauguuuggaugggccgcacgaucaaugagacauccagacugggguaugagaccuucaaggugaucgagggauggagcaaccccaaaucuaagcuccagauuaaucggcaggucaucguggaccgcggcgauagauccggcuacagcgggauuuuuagcaucgaaggaaaauccuguauuaaccggugcuucuaugucgagcugaucagaggccgcaaggaagagaccgaagugcuguggacaagcaauuccauuguuguguucugugggaccucuggaacauacggcacggggagcuggccugacggcgcugaucucaaccugaugcccaucuga

SEQ ID NO: 208639 - RNA, 1410 nt, Artificial Sequence; identical to SEQ ID NO: 208622
  derived and/or modified sequence opt5 from neuraminidase__InfluenzaA__AIJ10848

SEQ ID NO: 208640 - RNA, 1410 nt, Artificial Sequence
  derived and/or modified sequence opt5 from neuraminidase__InfluenzaA__AIJ10849
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuuuagaacacugcucaugaaugaacugggggugccuuuccaccugggaaccaagcaggucugcauugccugguccucuucuuccugucaugauggcaaagccuggcuccacgugugcaucacaggcgacgauaagaacgcuaccgccagcuuuauuuauaaugggcggcugguugacucuguggucuccuggagcaaagagauccuucgcacccaggaaucugagugugugugcauuaacggaacauguacgguggucaugaccgauggcuccgcuagcgggaaggccguuacaaaaauccuguucaucgaggaaggaaagauugugcauaccuccacacucucuggcagcgcgcaacacguggaggaaugcuccugcuaccccagauauccugggguccggugugugugccgcgacaacuggaagggaagcaauagacccaucguugauauuaacaucaaagaccacucuauuguguccggcuacgucuguagcggccuggugggggauaccccgcggaagaaugacucuagcuccucuagccauugccuugacccuaacaaugaggaaggaggccacgggguuaaaggaugggccuuugaugacggcaacgauguguggauggggcgcacgaucaaugagacauccagacugggauacgagaccuucaaggucaucgaaggcuggagcaaccccaaaucuaagcuccagauuaaucgccaggugaucgucgaccggggcgauagauccggguauagcggaauuuuuagcguggagggcaaauccuguaucaaccggugcuucuacguugaacugauuagagggcgcaaggaggaaaccgaggugcuguggacaagcaauuccaucgucguguucuguggaaccucuggcacauaugggacgggcagcuggccugacggagcugaucucaaccugaugcccauuuga

SEQ ID NO: 208641 - RNA, 1410 nt, Artificial Sequence; identical to SEQ ID NO: 208640
  derived and/or modified sequence opt5 from neuraminidase__InfluenzaA__AIJ10851

SEQ ID NO: 208642 - RNA, 1410 nt, Artificial Sequence; identical to SEQ ID NO: 208640
  derived and/or modified sequence opt5 from neuraminidase__InfluenzaA__AIJ10852

SEQ ID NO: 208643 - RNA, 1410 nt, Artificial Sequence; identical to SEQ ID NO: 208636
  derived and/or modified sequence opt5 from neuraminidase__InfluenzaA__AIJ10853

SEQ ID NO: 208644 - RNA, 1410 nt, Artificial Sequence; identical to SEQ ID NO: 208636
  derived and/or modified sequence opt5 from neuraminidase__InfluenzaA__AIJ10854

SEQ ID NO: 208645 - RNA, 1410 nt, Artificial Sequence
  derived and/or modified sequence opt5 from neuraminidase__InfluenzaA__AIJ10855
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuuuagaacacugcucaugaaugaacugggggugccuuuccaccugggaaccaagcaggucugcauugccugguccucuucuuccugucaugauggcaaagccuggcuccacgugugcaucacaggcgacgauaagaacgcuaccgccagcuuuauuuauaaugggcggcugguugacucuguggucuccuggagcaaagagauccuucgcacccaggaaucugagugugugugcauuaacggaacauguacgguggucaugaccgauggcuccgcuagcgggaaggccguuacaaaaauccuguucaucgaggaaggaaagauugugcauaccuccacacucucuggcagcgcgcaacacguggaggaaugcuccugcuaccccagauauccugggguccggugugugugccgcgacaacuggaagggaagcaauagacccaucguugauauuaacaucaaagaccacucuauuguguccggcuacgucuguagcggccuggugggggauaccccgcggaagaaugacucuagcuccucuagccauugccuugacccuaacaaugaggaaggagaucacggcguuaaagggugggccuuugacgauggaaacgacguguggaugggccgcacgaucaaugagacauccagacugggguacgagaccuucaaggucaucgaaggauggagcaaccccaaaucuaagcuccagauuaaucgccaggugaucgucgaucggggcgacagauccggcuauagcgggauuuuuagcguggagggaaaauccuguaucaaccggugcuucuacguugaacugauuagaggccgcaaggaggaaaccgaggugcuguggacaagcaauuccaucgucguguucugugggaccucuggaacauauggcacggggagcuggccugauggcgcugaccucaaccugaugcccauuuga

SEQ ID NO: 208646 - RNA, 1410 nt, Artificial Sequence
  derived and/or modified sequence opt5 from neuraminidase__InfluenzaA__AIJ10856
augaaccccaauaagaaaaucauuaccaucggcagcgugucccugacaauuucuacgaucugcuucuuuaugcagauugccauccucaucaccacagucacccugcacuucaagcaauacgaguuuaacagcccuccgaauaaccagguuaugcuuugugaacccacaauuaucgagagaaauauuaccgaaaucguguaucugacaaacaccacgauugagaaagaaaucugcccuaagcccgcugaguaccggaauugguccaaaccucagugugggauuaccggauucgcccccuuuucuaaggacaacagcauccgccucuccgcgggcggggauaucugggugacaagagagccuuaugucucuugcgacccggauaaguguuaccaguucgcucugggacaaggcaccacacuuaaaaaugugcauagcaacaauaccguucgggaccgcacgcccuauagaacacugcucaugaacgaacugggggugccuuuucaccugggaaccaagcaggucugcauugccugguccucuagcuccugucaugauggcaaagccuggcuccacgugugcaucacaggcgacgauaagaaugcuaccgccagcuucauuuacaacgggcggcugguugacucuguggucuccuggagcaaagauauccuucgcacccaggagucugaaugugugugcauuaauggaacauguacgguggucaugaccgacggcuccgcuagcgggaaggccgauacaaagauccuguuuaucgaggagggaaaaauuguucauaccuccacacucucuggcagcgcgcagcacguggaagagugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuucuccucugggcauugccuugacccuaauaacgaagagggaggccacggggugaaaggaugggccuuugaugacggcaaugauguuuggauggggcgcacgaucaacgaaacaagcagacugggauaugagaccuucaaggugaucgagggcugguccaaucccaaaagcaagcuccaaauuaaccggcaggucaucguggaccgcggcgauagaucuggguacuccggaauuuuuagcaucgaaggcaagucuuguauuaaucggugcuucuaugucgagcugaucagagggcgcaaagaagagaccgaagugcuguggacauccaacagcauuguuguguucuguggaaccuccggcacauacgggacgggcucuuggccugacggagcugaucucaaucugaugcccaucuga

SEQ ID NO: 208647 - RNA, 1410 nt, Artificial Sequence; identical to SEQ ID NO: 208622
  derived and/or modified sequence opt5 from neuraminidase__InfluenzaA__AIJ10857

SEQ ID NO: 208648 - RNA, 1410 nt, Artificial Sequence; identical to SEQ ID NO: 205170
  derived and/or modified sequence opt5 from neuraminidase__InfluenzaA__AIJ29348

SEQ ID NO: 208649 - RNA, 1410 nt, Artificial Sequence; identical to SEQ ID NO: 205170
  derived and/or modified sequence opt5 from neuraminidase__InfluenzaA__AIJ29350

SEQ ID NO: 208650 - RNA, 1410 nt, Artificial Sequence
  derived and/or modified sequence opt5 from neuraminidase__InfluenzaA__AIJ29352
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcuaaguaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugagcugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggaaauccuucgcacccaggagucugaaugugugugcauuaacggaacauguacgguggucaugaccgauggcuccgcuagcgggaaagccgacacaaagauccuguuuaucgaggagggaaagauuguucauaccuccacacucucuggcagcgcgcaacacguggaagagugcuccugcuaucccagauacccuggggugcggugugucugccgcgauaacuggaaaggaagcaauagacccaucguggacauuaacaucaaggaucacucuauuguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacgaucaaugagacaagcagacugggguaugagaccuuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaggaagagaccgaaguucuguggacauccaauucuaucguggucuucugugggaccagcggaacauacggcacgggguccuggccugauggcgcugaccucaaccugaugcccauuuga

SEQ ID NO: 208651 - RNA, 1410 nt, Artificial Sequence; identical to SEQ ID NO: 204167
  derived and/or modified sequence opt5 from neuraminidase__InfluenzaA__AIJ29354

SEQ ID NO: 208652 - RNA, 1410 nt, Artificial Sequence; identical to SEQ ID NO: 205946
  derived and/or modified sequence opt5 from neuraminidase__InfluenzaA__AIJ29356

SEQ ID NO: 208653 - RNA, 1410 nt, Artificial Sequence; identical to SEQ ID NO: 205946
  derived and/or modified sequence opt5 from neuraminidase__InfluenzaA__AIJ29358

SEQ ID NO: 208654 - RNA, 1410 nt, Artificial Sequence
  derived and/or modified sequence opt5 from neuraminidase__InfluenzaA__AIJ29360
augaaccccaaucagaagaucauuaccaucggcagcgugucccugacaauuucuacgaucugcuucuuuaugcaaauugccauccucaccacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacccgcugaguaccggaauugguccaagccucagugugggaucacaggauucgcccccuuuucuaaagacaacagcauucgccucuccgcgggcggggauaucugggugaccagagagccuuaugucucuugcgacccggauaaguguuaccaauucgcucugggacagggcacaacccuuaauaacgugcauagcaauaacacgguucgggaccgcacacccuauagaacccugcucaugaaugaacugggggugccuuuucaccugggaacaaagcaggucugcaucgccugguccucuagcuccugucaugauggcaaagccuggcuccacgugugcauuaccggcgacgauaagaacgcuaccgccagcuucaucuacaaugggcggcugguugacucuguggucuccuggagcaaagagauucuucgcacacaggaaucugagugugugugcaucaacggaacguguaccguggucaugacagauggcuccgcuagcgggaaggccgacaccaaaauucuguuuaucgaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 208655 - RNA, 1410 nt, Artificial Sequence; identical to SEQ ID NO: 205170
  derived and/or modified sequence opt5 from neuraminidase__InfluenzaA__AIJ29362

SEQ ID NO: 208656 - RNA, 1410 nt, Artificial Sequence
  derived and/or modified sequence opt5 from neuraminidase__InfluenzaA__AIL93626
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuauguuaaccagacauacgugaauaucagcaacaccaauuucgccgcggggagauccguggucucugugaaacuugcuggaaacagcucccugugcccuguuagcggcugggccauuuauucuaaggacaauuccgugcggaucgggagcaaaggagaugucuuugugauccgcgagccguucauuucuuguagcccccucgaaugcagaacauuuuuccugacccagggcgcccuucugaacgacaagcauuccaauggcacaaucaaagaucggucuccuuaccgcacccucauguccugucccauuggggagguuccuagccccuauaacuccagauuugaaucuguggcuuggagcgccuccgcuugccacgacggaaucaacuggcugacgauuggcaucagcgggccugauucuggagccgucgcggugcugaaguacaauggcaucauuaccgacacaaucaaguccuggaaaaacaauauucuccggacccaggagagcgagugugccugcgugaacgggucuuguuucacaaucaugaccgauggaccgagcgacggccaggcuuccuauaagauuuuucgcaucgaaaaaggcaagaucgucaaaucuguugagaugaaugcccccaacuaccauuacgaagagugcagcuguuauccugauuccagcgagauuacgugcgugugcagagacaauuggcacgggucuaaccggcccuggguguccuucaaucaaaaccuggaauaccagaucggauauauuuguagcggcgucuuuggggauaauccucgccccaacgacaagacaggaucuugcggcccggugcuuuccaauggggcuaacggaguuaagggcuucagcuuuaaauacggcaaugggguguggaucggaagaaccaaguccauuucuagccggaaaggcuucgagaugaucugggauccuaacggguggacaggaaccgacaacaauuuuuccauuaagcaggacaucgucggcaucaacgaauggucuggguauagcggcuccuucgugcaacaucccgagcugaccggacucgauuguauucgcccuugcuucuggguugaacugaucagaggccggcccaaagagaauacaauuuggacgagcgggucuuccaucagcuuuuguggagugaacucugacaccgucggcugguccuggcccgauggggccgagcuuccuuucacaauugacaaguga

SEQ ID NO: 208657 - RNA, 1410 nt, Artificial Sequence
  derived and/or modified sequence opt5 from neuraminidase__InfluenzaA__AIL93648
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaagaauuguucauaccuccacacucucuggcagcgcgcaacacguggaggaaugcuccugcuauccccgguacccuggggugcgcugugucugcagagauaacuggaagggaagcaaucggcccaucguggacauuaacaucaaggaucacucuauuguuuccagcuacguguguucuggccuggucggcgacaccccgcgcaaaaaugacagcuccucuagcucccauugccuugauccuaacaaugaggaagggggacacggcgugaaggggugggccuucgacgauggaaacgacguuuggaugggcagaacgaucaaugagacaagccggcugggguaugagaccuuuaaagugaucgaaggauggucuaaccccaaguccaaacuccagauuaauaagcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 208658 - RNA, 1410 nt, Artificial Sequence; identical to SEQ ID NO: 205170
  derived and/or modified sequence opt5 from neuraminidase__InfluenzaA__AIL93660

SEQ ID NO: 208659 - RNA, 1410 nt, Artificial Sequence; identical to SEQ ID NO: 205170
  derived and/or modified sequence opt5 from neuraminidase__InfluenzaA__AIL93672

SEQ ID NO: 208660 - RNA, 1410 nt, Artificial Sequence
  derived and/or modified sequence opt5 from neuraminidase__InfluenzaA__AIL93684
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuccgccacagggcagucuguggucagcgugaaacuugcgggaaacuccagccugugcccuguuucuggcugggcuauuuacuccaaggacaauagcgugagaaucgggucuaaaggagaugucuucgugauccgggagccguuuauuuccuguagcccccucgaaugccgcaccuucuuucugacacagggcgcccuucugaacgacaagcauucuaauggcaccaucaaagauagauccccuuaucggacgcucaugagcugucccauuggggagguuccuucccccuacaacucucgcuucgaaagcguggccugguccgcuagcgccugccacgacggaaucaacuggcugaccauuggcaucucugggccugauuccggagcugucgccgugcugaaguauaauggcaucauuacagacaccaucaagagcuggaaaaacaauauucucagaacacaagagucugagugugcgugcgugaacgggagcuguuuuaccaucaugacggauggaccguccgacggccaggccucuuacaagauuuuccggaucgaaaaaggcaagaucgucaaaagcguugagaugaaugcucccaacuaucauuacgaagagugcuccuguuacccugauagcucugagauuacaugcgugugccgcgacaauuggcacggguccaacagacccugggugagcuuuaaucagaaccuggaauaucagaucggauacauuuguucuggcgucuucggggauaauccucggcccaacgacaagaccggauccugcggcccggugcuuagcaauggggccaacggaguuaagggcuuuuccuucaaauauggcaaugggguguggaucggacgcacaaagucuauuagcuccagaaaaggcuuugagaugaucugggauccuaacggguggaccggaaccgacaacaauuucucuauuaagcaagacaucgucggcaucaacgaauggagcggguacuccggcagcuuugugcagcaucccgagcugacaggacucgauuguauucggccuugcuucuggaucgaacugauucgcggcagacccaaagagaauacgaucuggaccucuggguccagcauuucuuucuguggaguuaacuccgacacagugggcuggagcuggcccgauggggcugagcuuccuuuuaccaucgacaaguga

SEQ ID NO: 208661 - RNA, 1410 nt, Artificial Sequence
  derived and/or modified sequence opt5 from neuraminidase__InfluenzaA__AIL93719
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaauaaacaggucaucguggaucggggcgaccgcagcggcuacucugggauuuucuccgucgagggaaagagcuguaucaacagaugcuuuuauguggaacugauucggggcagaaaggaggaaaccgagguucuguggacauccaauucuaucguggucuucugugggaccagcggaacauacggcacgggguccuggccugauggcgcugaccucaaccugaugcccauuuga

SEQ ID NO: 208662 - RNA, 1410 nt, Artificial Sequence; identical to SEQ ID NO: 208661
  derived and/or modified sequence opt5 from neuraminidase__InfluenzaA__AIL93743

SEQ ID NO: 208663 - RNA, 1410 nt, Artificial Sequence; identical to SEQ ID NO: 208661
  derived and/or modified sequence opt5 from neuraminidase__InfluenzaA__AIL93755

SEQ ID NO: 208664 - RNA, 1410 nt, Artificial Sequence; identical to SEQ ID NO: 205170
  derived and/or modified sequence opt5 from neuraminidase__InfluenzaA__AIL93767

SEQ ID NO: 208665 - RNA, 1410 nt, Artificial Sequence; identical to SEQ ID NO: 205170
  derived and/or modified sequence opt5 from neuraminidase__InfluenzaA__AIL93779

SEQ ID NO: 208666 - RNA, 1410 nt, Artificial Sequence
  derived and/or modified sequence opt5 from neuraminidase__InfluenzaA__AIL93791
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcccgcugaauaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugagcugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggaaauccuucgcacccaggagucugaaugugugugcauuaacggaacauguacgguggucaugaccgauggcuccgcuagcgggaaagccgacacaaagauccuguuuaucgaggagggaaagauuguucauaccagaacacucuccggcucugcgcaacacguggaagagugcagcugcuauccccgguacccuggggugcgcugugucugcagagauaacuggaaaggauccaaucggcccaucguggacauuaacaucaaggaucacagcauuguuucuuccuacguguguagcggccuggucggcgacaccccgcgcaaaaaugacucuagcuccucuagccauugccuugauccuaacaaugaagaagggggacacggcgugaaggggugggccuucgacgauggaaacgacguuuggaugggcagaacgaucaaugagacaucccggcugggguaugagaccuuuaaagugaucgagggauggagcaaccccaagucuaaacuccagauuaauaagcaggucaucguggaucgcggcgacagauccggcuacagcgggauuuucucugucgaaggaaaguccuguaucaaccggugcuuuuauguggagcugauuagaggccgcaaagaagagaccgaaguucuguggacaagcaauuccaucguggucuucugugggaccucuggaacauacggcacggggagcuggccugauggcgcugaccucaaccugaugcccauuuga

SEQ ID NO: 208667 - RNA, 1410 nt, Artificial Sequence; identical to SEQ ID NO: 208661
  derived and/or modified sequence opt5 from neuraminidase__InfluenzaA__AIL93803

SEQ ID NO: 208668 - RNA, 1410 nt, Artificial Sequence
  derived and/or modified sequence opt5 from neuraminidase__InfluenzaA__AIL93815
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuacuccuauguguguagcggccuggucggcgacaccccgcggaagaaugacucuagcuccucuagccauugccuuaacccuaauaacgaggaagggggacacggcgugaaagggugggccuucgaugacggaaaugauguuuggaugggccgcacgaucaacgagacauccagacugggguacgagaccuuuaaggugaucgaaggauggagcaaucccaaaucuaagcuccagauuaaccggcaggucaucguggaccgcggcgauagauccggcuauagcgggauuuucucugucgagggaaaauccuguaucaaucggugcuuuuacguggaacugauuagaggccgcaaggaggaaaccgagguucuguggacaagcaacuccaucguggucuucugugggaccucuggaacauauggcacggggagcuggccugacggcgcugaucucaaucugaugcccauuuga

SEQ ID NO: 208669 - RNA, 1410 nt, Artificial Sequence; identical to SEQ ID NO: 205170
  derived and/or modified sequence opt5 from neuraminidase__InfluenzaA__AIL93827

SEQ ID NO: 208670 - RNA, 1410 nt, Artificial Sequence
  derived and/or modified sequence opt5 from neuraminidase__InfluenzaA__AIL93839
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccacagggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggaaaaacaauauucucagaacacaagagagcgagugugcgugcgugaacgggucuuguuucaccaucaugacggauggaccgagcgacggccaggccuccuacaagauuuuucggaucgaaaaaggcaagaucgucaaaucuguugagaugaaugcucccaacuaucauuacgaagagugcagcuguuacccugauuccagcgagauuacaugcgugugccgcgacaauuggcacgggucuaacagacccuggguguccuucaaucagaaccuggaauaucagaucggauacauuuguagcggcgucuuuggggauaauccucggcccaacgacaagaccggaucuugcggcccgguguccagcaauggggccaacggaguuaagggcuucuccuuuaaauauggcaaugggguguggaucggacgcacaaagucuauuagcuccagaaaaggcuucgagaugaucugggauccuaacggguggaccggaaccgacaacaauuuuucuauuaagcaagacaucgucggcaucaacgaauggagcggguacuccggcagcuucgugcagcaucccgagcuuacaggacuggauuguauucggccuugcuucuggguugaacucauccgcggcagacccaaagagaauacgauuuggaccucuggguccagcaucucuuuuuguggagugaacuccgacacagucggcuggagcuggcccgauggggcugagcugccuuucaccauugacaaguga

SEQ ID NO: 208671 - RNA, 1410 nt, Artificial Sequence
  derived and/or modified sequence opt5 from neuraminidase__InfluenzaA__AIL93850
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccacagggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggaaaaacaauauucucagaacacaagagagcgagugugcgugcgugaacgggucuuguuucaccaucaugacggauggaccgagcgacggccaggccuccuacaagauuuuucggaucgaaaaaggcaagaucgucaaaucuguugagaugaaugcucccaacuaucauuacgaagagugcagcuguuacccugauuccagcgagauuacaugcgugugccgcgacaauuggcacgggucuaacagacccuggguguccuucaaucagaaccuggaauaucagaucggauacauuuguagcggcgucuuuggggauaauccucggcccaacgacaagaccggaucuugcggcccgguguccagcaauggggccaagggaguuaaaggcuucuccuuuaaguauggcaacgggguguggaucggacgcacaaaaucuauuagcuccagaaagggcuucgagaugaucugggauccuaauggguggaccggaaccgacaacaacuuuucuauuaaacaagacaucgucggcaucaaugaauggagcggguacuccggcagcuucgugcagcaucccgagcuuacaggacuggauuguauucggccuugcuucuggguugaacucauccgcggcagacccaaggagaacacgauuuggaccucuggguccagcaucucuuuuuguggagucaauuccgacacagugggcuggagcuggcccgauggggcugagcugccuuucaccauugacaaauga

SEQ ID NO: 208672 - RNA, 1410 nt, Artificial Sequence; identical to SEQ ID NO: 208661
  derived and/or modified sequence opt5 from neuraminidase__InfluenzaA__AIL93861

SEQ ID NO: 208673 - RNA, 1410 nt, Artificial Sequence
  derived and/or modified sequence opt5 from neuraminidase__InfluenzaA__AIL93885
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucuggggucuucuccguggagggaaaaagcuguauuaaucggugcuuuuauguugaacugaucagaggccgcaaggaggaaaccgaggugcuguggacauccaacucuauugucguguucugugggaccagcggaacauacggcacgggguccuggccugacggcgcugaucucaaucugaugcccaucuga

SEQ ID NO: 208674 - RNA, 1410 nt, Artificial Sequence; identical to SEQ ID NO: 208661
  derived and/or modified sequence opt5 from neuraminidase__InfluenzaA__AIL93897

SEQ ID NO: 208675 - RNA, 1410 nt, Artificial Sequence
  derived and/or modified sequence opt5 from neuraminidase__InfluenzaA__AIL93909
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauucuggagcuguggccguccugaaguauaauggcauuaucacagacaccauuaaguccuggagaaacaauauccuccggacacaagagagcgagugugugugcgugaacgggucuuguuucaccauuaugacggauggaccgagcgacggccaggcguccuacaaaaucuuucgcaucgaaaagggcaaaauugucaagucuguugagaugaaugcccccaacuaucauuacgaagagugcagcuguuacccugauuccagcgagaucacaugcgugugcagagacaauuggcacgggucuaaccggcccuggguguccuucaaucagaaccuggaauaucagauuggauacaucuguagcggcauuuuuggggauaauccucgccccaacgacaaaaccggaucuugcggcccggucuccagcaauggggcuaacggagugaagggcuucuccuuuaaguauggcaaugggguuuggaucggaagaacaaaaucuauuagcucccggaagggcuucgagaugaucugggauccuaacggguggaccggaaccgacaacaauuuuucuaucaaacaagacauugugggcaucaacgaauggagcggguacuccggcagcuucguccagcaucccgagcuuacaggacuggauuguauucgcccuugcuucuggguggaacucaucagaggccggcccaaggagaauacgauuuggaccucuggguccagcaucucuuuuuguggaguuaacuccgacacagugggcuggagcuggcccgauggggccgagcugccuuucaccaucgacaaauga

SEQ ID NO: 208676 - RNA, 1410 nt, Artificial Sequence; identical to SEQ ID NO: 208661
  derived and/or modified sequence opt5 from neuraminidase__InfluenzaA__AIL93920

SEQ ID NO: 208677 - RNA, 1410 nt, Artificial Sequence
  derived and/or modified sequence opt5 from neuraminidase__InfluenzaA__AIL93943
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguucccccagcgaaugccgcaccuuuuuccucacacagggcgcccugcuuaacgacaagcauucuaauggcaccauuaaagauagauccccuuaucggacgcugaugagcugucccaucggggaggugccuucccccuacaacucucgcuuugaaagcgucgccugguccgcuagcgccugccacgacggaauuaacuggcucaccaucggcauuucugggccugauuccggagcuguggccgugcugaaguauaauggcaucaucacagacaccauuaagagcuggagaaacaauauccugcggacacaagagucugagugugcgugcgucaacgggagcuguuucaccauuaugacggauggaccguccgacggccaggccucuuacaaaaucuuucgcauugaaaagggcaaaaucguuaagagcguggagaugaaugcucccaacuaucauuacgaagagugcuccuguuacccugauagcucugagaucacaugcgugugcagagacaauuggcacggguccaaccggcccugggucagcuucaaucagaaccucgaauaucagauuggauacaucuguucuggcguguuuggggauaauccucgccccaacgacaaaaccggauccugcggcccgguuagcuccaauggggccaacggagugaagggcuucucuuuuaaguauggcaauggggucuggauuggaagaacaaaaagcaucuccucucggaagggcuucgagaugauuugggauccuaacggguggaccggaaccgacaacaauuuuagcaucaaacaagacauugugggcaucaaggaaugguccggguacagcggcucuuucguucagcaucccgagcugacaggacuugauuguauccgcccuugcuucuggguggaacugauuagaggccggcccgaggagaacacgaucuggaccuccgggagcucuauuuccuuuuguggagucaauagcgacacagugggcuggucuuggcccgauggggcugaacucccuuucaccaucgacaaauga

SEQ ID NO: 208678 - RNA, 1410 nt, Artificial Sequence; identical to SEQ ID NO: 208661
  derived and/or modified sequence opt5 from neuraminidase__InfluenzaA__AIL93954

SEQ ID NO: 208679 - RNA, 1410 nt, Artificial Sequence; identical to SEQ ID NO: 208661
  derived and/or modified sequence opt5 from neuraminidase__InfluenzaA__AIL93966

SEQ ID NO: 208680 - RNA, 1410 nt, Artificial Sequence
  derived and/or modified sequence opt5 from neuraminidase__InfluenzaA__AIL93978
augaaccccaaucagaagaucauuaccaucggcagcgugucccugacaauuucuacgaucugccucuucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacccgcugaguaccggaauugguccaagccucagugugggauuaccggauuugcccccuucucuaaagacaacagcauccgccuguccgcgggcggggauaucugggugacaagagagccuuaugucucuugcgacccggauaaguguuaccaauuugcucuuggacagggcaccacacugaauaacgugcauagcaauaacaccguucgggaccgcacgcccuauagaacacuccugaugaaugaacugggggugccuuuccaccucggaaccaagcaggucugcauugccugguccuccucuuccugucaugauggcaaagccuggcugcacgugugcaucacaggcgacgauaagaacgcuaccgccagcuuuauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuucaucgaggaaggaaagauuguucauaccuccacacugucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuugucggcgacaccccgcggaagaaugacagcuccucuagcucccauugccuggauccuaacaaugaggaagggggacacggcgugaaagggugggccuuugacgauggaaacgacguuuggaugggccgcacgaucaaugagacaagcagacucggguaugagaccuucaaggugaucgaaggauggucuaaccccaaauccaagcugcagauuaaucggcaggucaucguggaucgcggcgacagaagcggcuacucugggauuuuuagcgucgagggaaaaagcuguaucaaccggugcuucuauguggaacugauuagaggccgcaaggaggaaaccgagguucucuggacauccaauucuaucguggucuuuugugggaccagcggaacauacggcacgggguccuggccugauggcgcugaccugaaccuuaugcccauuuga

SEQ ID NO: 208681 - RNA, 1410 nt, Artificial Sequence; identical to SEQ ID NO: 208670
  derived and/or modified sequence opt5 from neuraminidase__InfluenzaA__AIL93990

SEQ ID NO: 208682 - RNA, 1410 nt, Artificial Sequence; identical to SEQ ID NO: 205170
  derived and/or modified sequence opt5 from neuraminidase__InfluenzaA__AIL94001

SEQ ID NO: 208683 - RNA, 1410 nt, Artificial Sequence; identical to SEQ ID NO: 208661
  derived and/or modified sequence opt5 from neuraminidase__InfluenzaA__AIL94013

SEQ ID NO: 208684 - RNA, 1410 nt, Artificial Sequence; identical to SEQ ID NO: 208661
  derived and/or modified sequence opt5 from neuraminidase__InfluenzaA__AIL94025

SEQ ID NO: 208685 - RNA, 1410 nt, Artificial Sequence; identical to SEQ ID NO: 208661
  derived and/or modified sequence opt5 from neuraminidase__InfluenzaA__AIL94037

SEQ ID NO: 208686 - RNA, 1410 nt, Artificial Sequence; identical to SEQ ID NO: 208661
  derived and/or modified sequence opt5 from neuraminidase__InfluenzaA__AIL94049

SEQ ID NO: 208687 - RNA, 1410 nt, Artificial Sequence; identical to SEQ ID NO: 208670
  derived and/or modified sequence opt5 from neuraminidase__InfluenzaA__AIL94061

SEQ ID NO: 208688 - RNA, 1410 nt, Artificial Sequence
  derived and/or modified sequence opt5 from neuraminidase__InfluenzaA__AIL94072
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccacagggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggaaaaacaauauucucagaacacaagagagcgagugugcgugcgugaacgggucuuguuucaccaucaugacggauggaccgagcgacggccaggccuccuacaagauuuuucggaucgaaaaaggcaagaucgucaaaucuguugagaugaaugcucccaacuaucauuacgaagagugcagcuguuacccugauuccagcgagauuacaugcgugugccgcgacaauuggcacgggucuaacagacccuggguguccuucaaucagaaccuggaauaucagaucggauacauuuguagcggcgucuuuggggauaauccucggcccaacgacaagaccggaucuugcggcccggugcuuuccaauggggccaacggaguuaagggcuucagcuuuaaauauggcaaugggguguggaucggacgcacaaaguccauuucuagcagaaaaggcuucgagaugaucugggauccuaacggguggaccggaaccgacaacaauuuuuccauuaagcaagacaucgucggcaucaacgaauggucuggguacagcggcuccuucgugcagcaucccgagcugacaggacucgauuguauucggccuugcuucuggaucgaacugauucgcggcagacccaaagagaauacgaucuggaccagcgggucuuccauuagcuuuuguggaguuaacucugacacagugggcugguccuggcccgauggggcugagcuuccuuucaccaucgacaaguga

SEQ ID NO: 208689 - RNA, 1410 nt, Artificial Sequence; identical to SEQ ID NO: 208670
  derived and/or modified sequence opt5 from neuraminidase__InfluenzaA__AIL94083

SEQ ID NO: 208690 - RNA, 1410 nt, Artificial Sequence; identical to SEQ ID NO: 208661
  derived and/or modified sequence opt5 from neuraminidase__InfluenzaA__AIL94238

SEQ ID NO: 208691 - RNA, 1410 nt, Artificial Sequence
  derived and/or modified sequence opt5 from neuraminidase__InfluenzaA__AIL94250
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucucugugaaacuugcuggaaacagcucccugugcccuguuagcggcugggccauuuacucuaaggacaauuccgugagaaucgggagcaaaggagaugucuuugugauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggagguuccuagccccuacaacucccgcuuugaaucuguggcuuggagcgccuccgcuugccacgacggaaucaacuggcugacgauuggcaucagcgggccugauucuggagccgucgcggugcugaaguauaauggcaucauuaccgacacaaucaaguccuggaaaaacaauauucucagaacccaagagagcgagugugccugcgugaacgggucuuguuucacaaucaugaccgauggaccgaaugacggccaggcuagcuacaagauuuuucggaucgaaaaaggcaagaucgucaaauccguugagaugaacgcccccaauuaucauuacgaagagugcucuuguuacccugauagcuccgagauuacgugcgugugccgcgacaacuggcacgggagcaauagacccugggugucuuucaaccagaaucuggaauaucagaucggauacauuuguuccggcgucuuuggggauaacccucggcccaaugacaagacaggaagcugcggcccggugucuuccaacggggcuaauggaguuaagggcuucagcuuuaaauauggcaacgggguguggaucggacgcaccaaguccauuucuagcagaaaaggcuucgagaugaucugggauccuaacggguggacaggaaccgacaauaacuuuuccauuaagcaagacaucgucggcaucaaugaauggucuggguacagcggcuccuucgugcagcaucccgagcuuaccggacuggauuguauucggccuugcuucuggguugaacucauccgcggcagacccaaagagaacacaauuuggacgagcgggucuuccaucagcuuuuguggagucaauucugacaccgugggcugguccuggcccgauggggccgagcugccuuucacaauugacaaguga

SEQ ID NO: 208692 - RNA, 1410 nt, Artificial Sequence; identical to SEQ ID NO: 205170
  derived and/or modified sequence opt5 from neuraminidase__InfluenzaA__AIL94261

SEQ ID NO: 208693 - RNA, 1410 nt, Artificial Sequence; identical to SEQ ID NO: 205170
  derived and/or modified sequence opt5 from neuraminidase__InfluenzaA__AIL94273

SEQ ID NO: 208694 - RNA, 1410 nt, Artificial Sequence; identical to SEQ ID NO: 205170
  derived and/or modified sequence opt5 from neuraminidase__InfluenzaA__AIL94285

SEQ ID NO: 208695 - RNA, 1410 nt, Artificial Sequence
  derived and/or modified sequence opt5 from neuraminidase__InfluenzaA__AIL94297
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccagaacacucuccggcucugcgcaacacguggaggaaugcagcugcuauccccgguacccuggggugcgcugugucugcagagauaacuggaagggauccaaucggcccaucguggacauuaacaucaaagaucacagcauuguuucuuccuacguguguagcggccuggucggcgacaccccgcgcaagaaugacucuagcuccucuagccauugccuugauccuaacaaugaggaagggggacacggcgugaaagggugggccuucgacgauggaaacgacguuuggaugggcagaacgaucaaugagacaucccggcugggguaugagaccuuuaaggugaucgaaggauggagcaaccccaaaucuaagcuccagauuaauaaacaggucaucguggaucgcggcgacagauccggcuacagcgggauuuucucugucgagggaaaguccuguaucaaccggugcuuuuauguggaacugauuagaggccgcaaggaggaaaccgagguucuguggacaagcaauuccaucguggucuucugugggaccucuggaacauacggcacggggagcuggccugauggcgcugaccucaaccugaugcccauuuga

SEQ ID NO: 208696 - RNA, 1410 nt, Artificial Sequence; identical to SEQ ID NO: 208661
  derived and/or modified sequence opt5 from neuraminidase__InfluenzaA__AIL94309

SEQ ID NO: 208697 - RNA, 1410 nt, Artificial Sequence; identical to SEQ ID NO: 208680
  derived and/or modified sequence opt5 from neuraminidase__InfluenzaA__AIL94321

SEQ ID NO: 208698 - RNA, 1410 nt, Artificial Sequence; identical to SEQ ID NO: 205170
  derived and/or modified sequence opt5 from neuraminidase__InfluenzaA__AIL94368

SEQ ID NO: 208699 - RNA, 1410 nt, Artificial Sequence
  derived and/or modified sequence opt5 from neuraminidase__InfluenzaA__AIL94380
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccgugguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaauaaacaggugauugucgaucggggcgaccgcagcggcuacucugggaucuucuccguggagggaaagagcuguauuaacagaugcuuuuauguugaacugauccggggcagaaaggaggaaaccgaggugcuguggacauccaauucuauugucguguucugugggaccagcggaacauacggcacgggguccuggccugauggcgcugaccucaaccugaugcccaucuga

SEQ ID NO: 208700 - RNA, 1410 nt, Artificial Sequence
  derived and/or modified sequence opt5 from neuraminidase__InfluenzaA__AIL94392
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucucugugaaacuugcuggaaacagcucccugugcccuguuagcggcugggccauuuacucuaaggacaauuccgugagaaucgggagcaaaggagaugucuuugugauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggagguuccuagccccuacaacucccgcuuugaaucuguggcuuggagcgccuccgcuugccacgacggaaucaacuggcugacgauuggcaucagcgggccugauucuggagccgucgcggugcugaaguauaauggcaucauuaccgacacaaucaaguccuggaaaaacaauauucucagaacccaagagagcgagugugccugcgugaacgggucuuguuucacaaucaugaccgauggaccgagcgacggccaggcuuccuacaagauuuuucggaucgaaaaaggcaagaucgucaaaucuguugagaugaaugcccccaacuaucauuacgaagagugcagcuguuacccugauuccagcgagauuacgugcgugugccgcgacaauuggcacgggucuaacagacccuggguguccuucaaucagaaccuggaauaucagaucggauacauuuguagcggcgucuuuggggauaauccucggcccaacgacaagacaggaucuugcggcccgguguccagcaauggggcuaacggaguuaagggcuucuccuuuaaauauggcaaugggguguggaucggacgcaccaagucuauuagcuccagaaaaggcuucgagaugaucugggauccuaacggguggacaggaaccgacaacaauuuuucuauuaagcaagacaucgucggcaucaacgaauggagcggguacuccggcagcuucgugcagcaucccgagcuuaccggacuggauuguauucggccuugcuucuggguugaacucauccgcggcagacccaaagagaauacaauuuggacgucuggguccagcaucucuuuuuguggagugaacuccgacaccgucggcuggagcuggcccgauggggccgagcugccuuucacaauugacaaguga

SEQ ID NO: 208701 - RNA, 1410 nt, Artificial Sequence
  derived and/or modified sequence opt5 from neuraminidase__InfluenzaA__AIL94403
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucucugugaaacuugcuggaaacagcucccugugcccuguuagcggcugggccauuuacucuaaggacaauuccgugagaaucgggagcaaaggagaugucuuugugauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggagguuccuagccccuacaacucccgcuuugaaucuguggcuuggagcgccuccgcuugccacgacggaaucaacuggcugacgauuggcaucagcgggccugauucuggagccgucgcggugcugaaguauaauggcaucauuaccgacacaaucaaguccuggaaaaacaauauucucagaacccaagagagcgagugugccugcgugaacgggucuuguuucacaaucaugaccgauggaccgagcgacggccaggcuuccuacaagauuuuucggaucgaaaaaggcaagaucgucaaaucuguugagaugaaugcccccaacuaucauuacgaagagugcagcuguuacccugauuccagcgagauuacgugcgugugccgcgacaauuggcacgggucuaacagacccuggguguccuucaaucagaaccuggaauaucagaucggauacauuuguagcggcgucuuuggggauaauccucggcccaacgacaagacaggaucuugcgauccgguguccagcaauggcgcuaacgggguuaagggauucuccuuuaaauauggcaauggcguguggaucgggcgcaccaagucuauuagcuccagaaaaggauucgagaugaucugggacccuaacggcuggacagggaccgacaacaauuuuucuauuaagcaagauaucgucggaaucaacgaauggagcggcuacuccgggagcuucgugcagcaucccgagcuuaccggccuggacuguauucggccuugcuucuggguugaacucauccgcggaagacccaaagagaauacaauuuggacgucuggcuccagcaucucuuuuuguggggugaacuccgauaccgucggauggagcuggcccgacggcgccgagcugccuuucacaauugauaaguga

SEQ ID NO: 208702 - RNA, 1410 nt, Artificial Sequence; identical to SEQ ID NO: 205170
  derived and/or modified sequence opt5 from neuraminidase__InfluenzaA__AIL94426

SEQ ID NO: 208703 - RNA, 1410 nt, Artificial Sequence
  derived and/or modified sequence opt5 from neuraminidase__InfluenzaA__AIL94438
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccacagggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggaaaaacaauauucucagaacacaagagagcgagugugcgugcgugaacgggucuuguuucaccaucaugacggauggaccgagcgacggccaggccuccuacaagauuuuucggaucgaaaaaggcaagaucgucaaaucuguugagaugaaugcucccaacuaucauuacgaagagugcagcuguuacccugauuccagcgagauuacaugcgugugccgcgacaauuggcacgggucuaacagacccuggguguccuucaaucagaaccuggaauaucagaucggauacauuuguagcggcgucuuuggggauaauccucggcccaacgacaagaccggaucuugcggcccgguguccagcaauggggccaacggaguuaagggcuucuccuuuaaauauggcaaugggguguggaucggacgcacaaagucugucagcuccagaaaaggcuucgagaugauuugggauccuaacggguggaccggaaccgacaacaauuuuucuaucaagcaagacauugugggcaucaacgaauggagcggguacuccggcagcuucguucagcaucccgagcuuacaggacuggauuguauccggccuugcuucuggguggaacucauucgcggcagacccaaagagaauacgaucuggaccucuggguccagcauuucuuuuuguggagucaacuccgacacagugggcuggagcuggcccgauggggcugagcugccuuucaccaucgacaaguga

SEQ ID NO: 208704 - RNA, 1410 nt, Artificial Sequence
  derived and/or modified sequence opt5 from neuraminidase__InfluenzaA__AIL94449
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcuaaguaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugagcugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggaaauccuucgcacccaggagucugaaugugugugcauuaacggaacauguacgguggucaugaccgauggcuccgcuagcgggaaagccgacacaaagauccuguuuaucgaggagggaaagauuguucauaccuccacacucucuggcagcgcgcaacacguggaagagugcuccugcuaucccagauacccuggggugcggugugucugccgcgauaacuggaaaggaagcaauagacccaucguggacauuaacaucaaggaucacucuauuguuuacuccuauguguguagcggccuggucggcgacaccccgcggaaaaaugacucuagcuccucuagccauugccuuaacccuaauaacgaagaagggggacacggcgugaaggggugggccuucgaugacggaaaugauguuuggaugggccgcacgaucaacgagacauccagacugggguacgagaccuuuaaagugaucgagggauggagcaaucccaagucuaaacuccagauuaaccggcaggucaucguggaccgcggcgauagauccggcuauagcgggauuuucucugucgaaggaaaguccuguaucaaucggugcuuuuacguggagcugauuagaggccgcaaggaagagaccgaaguucuguggacaagcaacuccaucguggucuucugugggaccucuggaacauauggcacggggagcuggccugacggcgcugaucucaaucugaugcccauuuga

SEQ ID NO: 208705 - RNA, 1410 nt, Artificial Sequence; identical to SEQ ID NO: 208699
  derived and/or modified sequence opt5 from neuraminidase__InfluenzaA__AIL94461

SEQ ID NO: 208706 - RNA, 1410 nt, Artificial Sequence
  derived and/or modified sequence opt5 from neuraminidase__InfluenzaA__AIL94473
augaaccccaaucagaagaucauuaccaucggcagcgugugcaugacaauugggauggccaaccugauccuccaaauuggaaauaucaucuccauuugggucggccacucuauccagcuggggaaccagagccagauugagacguguaaucaauccguuaucaccuacgaaaacaauacaugggugaaccagaccuaugugaauauuucuaacacaaauuucgcugccggacagagcgucgugccuguuaaacuugcgggcaacuccucucugugcccggugagcgggugggcuaucuacuccaaggacaauagcgucagaauuggaucuaaaggcgauguguuuguuauccgggagcccuucaucuccuguagcccucucgaaugccgcaccuuuuuccugacacagggcgcccuucugaacgacaagcauucuaaugggaccauuaaagauagaucccccuaucggacgcucaugagcuguccuaucggagaggugcccucuccuuacaacucccgcuuugaaagcgucgccugguccgcuucugccugccacgacggcauuaacuggcugaccaucgggauuagcggaccggauuccggcgcuguggccgugcugaaguauaaugggaucaucacagacaccauuaagagcuggagaaacaauauccuccggacacaagagucugagugugcgugcgucaacggauccuguuucaccauuaugacggauggccccagcgacggccaggccucuuacaaaaucuuucgcauugaaaaggggaaaaucguuaagagcguggagaugaauacaccuaacuaucauuacgaagagugcuccuguuaccccgauucuagcgagauuaccugcgugugcagagacaauuggcacggauccaaccggccuugggucagcuucaaucagaaccuggaauaucagaucggcuacaucuguucugggguguuuggagauaauccccgcccgaacgacaaaacaggcuccugcgggccuguuagcucuaauggagcuaacggcgugaagggcuucuccuuuaaguaugggaauggagucuggauuggcagaaccaaaagcaucuccucucggaagggguucgagaugauuugggaucccaacggauggaccggcacagacaacaauuuuagcaucaaacaagacauuguggggaucaaggaaugguccggcuacucuggcagcuucguucagcauccugagcuuacgggacuggauuguauccgccccugcuucuggguggaacucauuagagggcggcccgaggagaacaccaucuggacauccggaagcucuauuuccuuuuguggcgucaauagcgacaucgugggguggucuuggccugauggagccgaacugccguucaccauugacaaauga

SEQ ID NO: 208707 - RNA, 1410 nt, Artificial Sequence; identical to SEQ ID NO: 207760
  derived and/or modified sequence opt5 from neuraminidase__InfluenzaA__AIL94484

SEQ ID NO: 208708 - RNA, 1410 nt, Artificial Sequence; identical to SEQ ID NO: 208670
  derived and/or modified sequence opt5 from neuraminidase__InfluenzaA__AIL94507

SEQ ID NO: 208709 - RNA, 1410 nt, Artificial Sequence
  derived and/or modified sequence opt5 from neuraminidase__InfluenzaA__AIL94518
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaauaaacaggucaucguggaucggggcgaccgcagcggcuacucugggauuuucuccgucgagggaaagagcuguaucaacagaugcuuuuauguggaacugauucggggcagaaaggaggaaaccgagguucuguggacauccaauucuaucguggucuucugugggaccagcggaacauacggcacgggguccuggccugauggcgcugaccucucucugaugcccauuuga

SEQ ID NO: 208710 - RNA, 1410 nt, Artificial Sequence
  derived and/or modified sequence opt5 from neuraminidase__InfluenzaA__AIL94530
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuuaacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 208711 - RNA, 1410 nt, Artificial Sequence; identical to SEQ ID NO: 208700
  derived and/or modified sequence opt5 from neuraminidase__InfluenzaA__AIL94542

SEQ ID NO: 208712 - RNA, 1410 nt, Artificial Sequence; identical to SEQ ID NO: 208670
  derived and/or modified sequence opt5 from neuraminidase__InfluenzaA__AIL94553

SEQ ID NO: 208713 - RNA, 1410 nt, Artificial Sequence; identical to SEQ ID NO: 208661
  derived and/or modified sequence opt5 from neuraminidase__InfluenzaA__AIL94564

SEQ ID NO: 208714 - RNA, 1410 nt, Artificial Sequence; identical to SEQ ID NO: 208670
  derived and/or modified sequence opt5 from neuraminidase__InfluenzaA__AIL94576

SEQ ID NO: 208715 - RNA, 1410 nt, Artificial Sequence
  derived and/or modified sequence opt5 from neuraminidase__InfluenzaA__AIL94587
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucucugugaaacuugcuggaaacagcucccugugcccuguuagcggcugggccauuuacucuaaggacaauuccgugagaaucgggagcaaaggagaugucuuugugauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggagguuccuagccccuacaacucccgcuuugaaucuguggcuuggagcgccuccgcuugccacgacggaaucaacuggcugacgauuggcaucagcgggccugauucuggagccgucgcggugcugaaguauaauggcaucauuaccgacacaaucaaguccuggaaaaacaauauucucagaacccaagagagcgagugugccugcgugaacgggucuuguuucacaaucaugaccgauggaccgagcgacggccaggcuuccuacaagauuuuucggaucgaaaaaggcaagaucgucaaaucuguugagauggaugcccccaauuaucauuacgaagagugcagcuguuacccugacuccagcgagauuacgugcgugugccgcgauaacuggcacgggucuaauagacccuggguguccuucaaccagaaucuggaauaucagaucggauacauuuguagcggcgucuuuggggacaacccucggcccaaugauaagacaggaucuugcggcccgguguccagcaacggggcuaauggaguuaagggcuucuccuuuaaauauggcaacgggguguggaucggacgcaccaagucuauuagcuccagaaaaggcuucgagaugaucugggacccuaauggguggaacggaacagacaacaauuuuucuauuaagcaagauaucgucggcaucaacgaauggagcggguacuccggcagcuucgugcagcaucccgagcuuaccggacuggacuguauucggccuugcuucuggguugaacucauccgcggcagacccaaagagaauaccauuuggacagggggaucuuccaucagcuuuuguggcgugaacucugauacggucgggugguccuggcccgacggagccgagcugccuuucaccauugauaaguga

SEQ ID NO: 208716 - RNA, 1410 nt, Artificial Sequence; identical to SEQ ID NO: 208700
  derived and/or modified sequence opt5 from neuraminidase__InfluenzaA__AIL94598

SEQ ID NO: 208717 - RNA, 1410 nt, Artificial Sequence
  derived and/or modified sequence opt5 from neuraminidase__InfluenzaA__AIL94609
augaaccccaaucagaagaucauuaccaucggcagcgugucccugacaauuucuacgaucugccucuucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacccgcugaguaccggaauugguccaagccucagugugggauuaccggauuugcccccuucucuaaagacaacagcauccgccuguccgcgggcggggauaucugggugacaagagagccuuaugucucuugcgacccggauaaguguuaccaauuugcucuuggacagggcaccacacugaauaacgugcauagcaauaacaccguucgggaccgcacgcccuauagaacacuccugauguccgaacugggggugccuuuccaccucggaaccaagcaggucugcauugccuggucuagcuccagcugucaugauggcaaagccuggcugcacgugugcaucacaggcgacgauaagaaugcuaccgccucuuuuauuuacaacgggcggcuuguugacuccguggucagcuggucuaaagagauccugcgcacccaggaauccgagugugugugcauuaauggaacauguacgguggucaugaccgauggcagcgcuuccgggaaggccgacacaaaaauccucuucaucgaggaaggaaagauuguucauaccucuacacugagcggcuccgcgcaacacguggaggaaugcagcugcuauccccuuuacccuggggugagaugugucugccgggauaacuggaagggaucuaaccgccccaucguggacauuaauaucaaagaucacuccauuguuagcucuuacguguguagcggccuggucggcgacaccccgagaaagaacgacuccucuagcuccagccauugccucgauccuaauaacgaggaagggggacacggcgugaaagggugggccuuugacgauggaaaugacguuuggaugggccggacgaucaacgagacaucucgccugggguaugagaccuucaaggugaucgaaggaugguccaaucccaaaagcaagcugcagauuaacagacaggucaucguggaucggggcgaccgcucuggcuacuccgggauuuuuagcgucgagggaaaauccuguaucaauagaugcuucuauguggaacucauucggggcagaaaggaggaaaccgagguucuguggacaucuaacagcaucguggucuuuugugggaccuccggaacauacggcacggggucuuggccugauggcgcugaccuuaaucugaugcccauuuga

SEQ ID NO: 208718 - RNA, 1410 nt, Artificial Sequence
  derived and/or modified sequence opt5 from neuraminidase__InfluenzaA__AIL94621
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucccugugaaacuugcuggaaacucuagccugugcccgguuuccggcugggccauuuacagcaaggacaauucugugagaaucggguccaaaggagaugucuuugugauccgggagcccuucauuagcuguucuccucucgaaugccgcacauuuuuccugacccagggcgcccuucugaacgacaagcauuccaauggcacaaucaaagauagaagccccuaucggacccucaugucuuguccuauuggggagguucccuccccuuacaacagccgcuuugaauccguggcuuggucugccagcgcuugccacgacggaaucaacuggcugacgauuggcaucuccgggccggauagcggagccgucgcggugcugaaguauaauggcaucauuaccgacacaaucaagucuuggaaaaacaauauucucagaacccaagaguccgagugugccugcgugaacgggagcuguuucacaaucaugaccgauggacccucugacggccaggcuagcuacaagauuuuucggaucgaaaaaggcaagaucgucaaauccguugagaugaaugccccuaacuaucauuacgaagagugcucuuguuaccccgauagcuccgagauuacgugcgugugccgcgacaauuggcacgggagcaacagaccuugggugucuuucaaucagaaccuggaauaucagaucggauacauuuguuccggcgucuuuggggauaauccccggccgaacgacaagacaggaagcugcggcccugugucuuccaauggggcuaacggaguuaagggcuucagcuuuaaauauggcaaugggguguggaucggacgcaccaaguccauuucuagcagaaaaggcuucgagaugaucugggaucccaacggguggacaggaaccgacaacgacuuuuccauuaagcaagauaucgucggcaucaaugaauggucuggguacagcggcuccuucgugcagcauccugagcuuaccggacuggacuguauucggcccugcuucuggguugaacucauccgcggcagacccaaagagaacacaauuuggacgagcgggucuuccaucagcuuuuguggagucaauucugauaccgugggcugguccuggccugacggggccgagcugccguucacaauugauaaguga

SEQ ID NO: 208719 - RNA, 1410 nt, Artificial Sequence; identical to SEQ ID NO: 208670
  derived and/or modified sequence opt5 from neuraminidase__InfluenzaA__AIL94632

SEQ ID NO: 208720 - RNA, 1410 nt, Artificial Sequence; identical to SEQ ID NO: 205170
  derived and/or modified sequence opt5 from neuraminidase__InfluenzaA__AIL94643

SEQ ID NO: 208721 - RNA, 1410 nt, Artificial Sequence
  derived and/or modified sequence opt5 from neuraminidase__InfluenzaA__AIL94655
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauucuggagcuguggccguccugaaguauaauggcauuaucacagacaccauuaaguccuggagaaacaauauccuccggacacaagagagcgagugugcgugcgugaacgggucuuguuucaccauuaugacggauggaccgagcgacggccaggccuccuacaaaaucuuucgcaucgaaaagggcaaaauugugaagucugucgagaugaaugcucccaacuaucauuacgaagagugcagcuguuacccugauuccagcgagaucacaugcguuugcagagacaauuggcacgggucuaaccggcccuggguguccuucaaucagaaccuggaauaucagauuggauacaucuguagcggcauuuuuggggauaauccucgccccaacgacaaaaccggaucuugcggcccgguguccagcaauggggccaacggagucaagggcuucuccuuuaaguauggcaaugggguguggaucggaagaacaaaaucuauuagcucccggaagggcuucgagaugaucugggauccuaacggguggaccggaaccgacaacaauuuuucuaucaaacaagacauuguuggcaucaacgaauggagcggguacuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaacuccgacacaguuggcuggagcuggcccgauggggcugagcugccuuucaccaucgacaaauga

SEQ ID NO: 208722 - RNA, 1410 nt, Artificial Sequence
  derived and/or modified sequence opt5 from neuraminidase__InfluenzaA__AIL94677
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucccugugaaacuugcuggaaacucuagccugugcccgguuuccggcugggccauuuacagcaaggacaauucugugagaaucggguccaaaggagaugucuuugugauccgggagcccuucauuagcuguucuccucucgaaugccgcacauuuuuccugacccagggcgcccuucugaacgacaagcauuccaauggcacaaucaaagauagaagccccuaucggacccucaugucuuguccuauuggggagguucccuccccuuacaacagccgcuuugaauccguggcuuggucugccagcgcuugccacgacggaaucaacuggcugacgauuggcaucuccgggccggauagcggagccgucgcggugcugaaguauaauggcaucauuaccgacacaaucaagucuuggaaaaacaauauucucagaacccaagaguccgagugugccugcgugaacgggagcuguuucacaaucaugaccgauggacccucugacggccaggcuagcuacaagauuuuucggaucgaaaaaggcaagaucgucaaauccguugagaugaaugccccuaacuaucauuacgaagagugcucuuguuaccccgauagcuccgagauuacgugcgugugccgcgacaauuggcacgggagcaacagaccuugggugucuuucaaucagaaccuggaauaucagaucggauacauuuguuccggcgucuuuggggauaauccccggccgaacgacaagacaggaagcugcggcccugugucuuccaauggggcuaacggaguuaagggcuucagcuuuaaauauggcaaugggguguggaucggacgcaccaaguccauuucuagcagaaaaggcuucgagaugaucugggaucccaacggguggacaggaaccgacaacaauuuuuccauuaagcaagacaucgucggcaucaacgaauggucuggguacagcggcuccuucgugcagcauccugagcuuaccggacuggauuguauucggcccugcuucuggguugaacucauccgcggcagacccaaagagaauacaauuuggacgagcgggucuuccaucagcuuuuguggagugaacucugacaccgucggcugguccuggccugauggggccgagcugccguucacaauugacaaguga

SEQ ID NO: 208723 - RNA, 1410 nt, Artificial Sequence; identical to SEQ ID NO: 208661
  derived and/or modified sequence opt5 from neuraminidase__InfluenzaA__AIL94688

SEQ ID NO: 208724 - RNA, 1410 nt, Artificial Sequence
  derived and/or modified sequence opt5 from neuraminidase__InfluenzaA__AIL94700
augaaccccaaucagaagaucauuaccaucggcagcgugucccugacaauuucuacgaucugcuucuuuaugcaaauugccauccucaucaccauugucacacugcacuucaaacaguacgaguuuaacagcccuccgaauaaccagguuaugcuuugugaacccaccaucauugagagaaauaucacagaaauuguguaucugaccaacacaaccaucgagaaggaaauuugcccuaaacccgcugaguaccggaauugguccaagccucagugugggaucacgggauucgcccccuuuucuaaagacaacagcauccgccucuccgcgggcggggauauuugggugaccagagagccuuaugucucuugcgacccggauaaguguuaccaauucgcucugggacagggcacaacccuuaauaacgugcauagcaauaacacaguucgggaccgcacccccuauagaacgcugcucaugaaugaacugggggugccuuuucaccugggaacaaagcaggucugcaucgccugguccucuagcuccugucaugauggcaaagccuggcuccacgugugcauuaccggcgacgauaagaacgcuacagccagcuucaucuacaaugggcggcugguugacucuguggucuccuggagcaaagagauucuucgcacccaggaaucugagugugugugcaucaacggaaccuguacaguggucaugacggauggcuccgcuagcgggaaggccgacaccaaaauccuguuuauugaggaaggaaagaucguucauauuuccacacucucuggcagcgcgcaacacguggaggaaugcuccugcuaucccagauacccuggggugcggugugucugccgcgauaacuggaagggaagcaauagacccaucguggacauuaacaucgaggaucacucuaucguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacaauuaaugagaccagcagacugggguaugagacguuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaagaagagacagagguucuguggaccuccaauucuaucguggucuucugugggaccagcggaacauacggcaccggguccuggccugauggcgcugaccucaaccugaugcccaucuga

SEQ ID NO: 208725 - RNA, 1410 nt, Artificial Sequence; identical to SEQ ID NO: 208670
  derived and/or modified sequence opt5 from neuraminidase__InfluenzaA__AIL94712

SEQ ID NO: 208726 - RNA, 1410 nt, Artificial Sequence; identical to SEQ ID NO: 208700
  derived and/or modified sequence opt5 from neuraminidase__InfluenzaA__AIL94723

SEQ ID NO: 208727 - RNA, 1410 nt, Artificial Sequence
  derived and/or modified sequence opt5 from neuraminidase__InfluenzaA__AIL94734
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgaacauagcaauaacaccgugcgggaccgcacgcccuauagaacacugcucaugaaugagcuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagaaauccuucgcacccaggagucugagugugucugcauuaacggaacauguacgguggugaugaccgauggcuccgcuagcgggaaggccgacacaaaaauccuguuuaucgaagagggaaagauuguccauaucuccacccucucuggcagcgcgcaacacguugaagagugcuccugcuaucccagauacccuggggugcggugugugugccgcgauaacuggaagggaagcaauagacccauugucgacaucaacauuaaagaucacucuaucguguccagcuacguuuguucuggccuggugggcgacacaccgcggaagaaugacagcuccucuagcucccauugccuugauccuaacaaugaagaagggggacacggcgucaaagggugggccuucgacgauggaaacgacguguggaugggccgcaccaucaaugagacgagcagacugggguaugagacauuuaagguuauugagggauggucuaaccccaaauccaagcuccagaucaaucgccaggugauugucgaucggggcgacagaagcggcuacucugggaucuucuccguggaaggaaaaagcuguauuaaccggugcuuuuaugucgagcugaucagaggccgcaaggaagagaccgaggugcuguggaccuccaauucuauuguuguguucugugggacaagcggaaccuacggcacaggguccuggccugauggcgcugaccucaaccugaugcccaucuga

SEQ ID NO: 208728 - RNA, 1410 nt, Artificial Sequence; identical to SEQ ID NO: 208670
  derived and/or modified sequence opt5 from neuraminidase__InfluenzaA__AIL94746

SEQ ID NO: 208729 - RNA, 1410 nt, Artificial Sequence; identical to SEQ ID NO: 208700
  derived and/or modified sequence opt5 from neuraminidase__InfluenzaA__AIL94757

SEQ ID NO: 208730 - RNA, 1410 nt, Artificial Sequence; identical to SEQ ID NO: 208661
  derived and/or modified sequence opt5 from neuraminidase__InfluenzaA__AIL94768

SEQ ID NO: 208731 - RNA, 1410 nt, Artificial Sequence; identical to SEQ ID NO: 205170
  derived and/or modified sequence opt5 from neuraminidase__InfluenzaA__AIL94780

SEQ ID NO: 208732 - RNA, 1410 nt, Artificial Sequence; identical to SEQ ID NO: 208700
  derived and/or modified sequence opt5 from neuraminidase__InfluenzaA__AIL94803

SEQ ID NO: 208733 - RNA, 1410 nt, Artificial Sequence; identical to SEQ ID NO: 208680
  derived and/or modified sequence opt5 from neuraminidase__InfluenzaA__AIL94814

SEQ ID NO: 208734 - RNA, 1410 nt, Artificial Sequence
  derived and/or modified sequence opt5 from neuraminidase__InfluenzaA__AIL94826
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccaaaccugcugaguaccggaauugguccaagccccagugugggauuaccggauucgccccuuuuucuaaagacaacagcauccgccuguccgcgggcggggauaucugggugacaagagagcccuaugucucuugcgacccugauaaguguuaccaauucgcucuuggacagggcaccacacugaauaacgugcauagcaauaacaccgcccgggaccgcacgccguauagaacacuccugaugaaugaacuggggguucccuuucaccucggaaccaaacaggugugcauugccugguccucuagcuccugucaugauggcaaggcuuggcugcacgucugcaucacaggcgacgauaagaacgccaccgcuagcuucauuuacaaugggcggcuuguggacucuguuguguccuggagcaaagagauccugcgcacccaggaaucugagugugucugcauuaacggaacauguacgguggugaugaccgauggcuccgccagcgggaaggcggacacaaaaauccucuuuaucgaggaaggaaagauuguccauaccuccacacugucuggcagcgcccaacacguugaggaaugcuccugcuauccuagauaccccggggugcggugugugugccgcgauaacuggaagggaagcaauagaccuaucgucgacauuaacaucaaagaucacucuauuguguccagcuacguuuguucuggccuugugggcgacacgccccggaagaaugacagcuccucuagcucccauugccugaacccgaauaacgaggaagggggacacggcgucaaagggugggcuuucgaugacggaaaugauguguggaugggccgcaccaucaacgagacaagcagacucggguaugagaccuuuaagguuaucgaaggauggucuaauccuaaauccaagcugcagauuaaccgccaggugaucgucgaccggggcgauagaagcggcuacucugggauuuucuccguggagggaaaaagcuguaucaaucggugcuuuuaugucgaacugauuagaggccgcaaggaggaaaccgaggugcucuggacauccaacucuaucguuguguucugugggaccagcggaacauacggcacgggguccuggcccgacggcgccgaucugaaucuuaugccuauuuga

SEQ ID NO: 208735 - RNA, 1410 nt, Artificial Sequence
  derived and/or modified sequence opt5 from neuraminidase__InfluenzaA__AIL94850
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuucgaacccacaauuaucgagagaaauauuaccgaaaucguguaucugacaaacaccacgauugagaaggaaaucuguccuaaacucgcugaguaccggaauugguccaagccccagugcgacauuaccggguuugccccuuucucuaaagauaacagcauccgccuguccgcgggaggcgacaucugggugacaagagagcccuaugucucuugugauccugacaagugcuaccaauuugcucuugggcagggaaccacacugaauaacgugcauagcaaugauaccguucgggaccgcacgccguauagaacacuccugaugaacgaacugggcgugcccuuccaccucgggaccaagcaggucuguauugccugguccucuagcuccugccaugauggaaaagccuggcugcacguguguaucacaggcgacgauaagaaugcuaccgccagcuuuauuuacaacggccggcuuguugacucuaucguguccuggagcaaagagauucugcgcacccaggaaucugagugcgucuguaucaaugggacaugcacgguggugaugaccgauggauccgcuagcggcaaggccgacacaaaaauccucuucauuaaggaggggaagaucguccauaccuccacacugucuggaagcgcgcaacacguugaagaguguuccugcuauccuagauaccccggcgugcggugcgugugucgcgauaacuggaaagggagcaacagaccuauugucgacaucaauauuaaggaccacucuaucguguccagcuacguuugcucuggacuugugggcgauacgccccggaaaaacgacagcuccucuagcucccauugucuggauccgaauagcgaagagggcgggcacggagucaagggcugggccuuugacgaugggaacgacguguggaugggacgcaccaucucugaaaaauccagacucggcuaugagacauucaagguuauugagggguggagcaauccuaaaucuaaguuucagaucaaccgccaggugauugucgaucggggaaauagauccggcuacagcggcaucuucuccguggaagggaagucuugcauuaaccgguguuucuaugucgagcugaucagaggacgcaaagaagagaccgaagugcuguggaccagcaauuccauuguuguguuuugcggcacaucugggaccuacggaacaggcagcuggcccgacggggcugaucucaaccugaugccuaucuga

SEQ ID NO: 208736 - RNA, 1410 nt, Artificial Sequence; identical to SEQ ID NO: 202434
  derived and/or modified sequence opt5 from neuraminidase__InfluenzaA__AIL94862

SEQ ID NO: 208737 - RNA, 1410 nt, Artificial Sequence; identical to SEQ ID NO: 202434
  derived and/or modified sequence opt5 from neuraminidase__InfluenzaA__AIL94874

SEQ ID NO: 208738 - RNA, 1410 nt, Artificial Sequence
  derived and/or modified sequence opt5 from neuraminidase__InfluenzaA__AIL94886
augaaccccaaucagaagaucauuaccaucggcagcgugugcaugacaauugggauggccaaccugaugcuccaaaucggaaauauuaucuccaucuggauuucucacagcauccagcugggcaacaaaaaucagauugagacguguaaccaguccgucaucaccuacgaaaauaacacauggguuaaucaaaccuaugugaacauuucuaauacaaacuucgcugccgggcagagcguggucuccgugaagaucgcgggaaauucuagccuuugcccuguuuccggcugggcuauuuacagcaaagacaacucuaucagaaucggguccaagggagauguguuugucauucgggagccguucaucagcuguucuccccuggaaugccgcaccuuuuuccucacacagggcgcccugcuuaaugacaaacauuccaacggcaccauuaaggauagaagcccuuaucggacgcugaugucuugucccaucggggaggugccuucccccuacaacagccgcuuugaauccguugccuggucugcuagcgccugccacgacggaauuaauuggcucaccaucggcaucuccgggccugaugacggagcuguggccguccugaaguauaacggcauuaucacagauaccauuaaaagcuggagaaauaacauccugcggacacaggagucugagugugcgugcgugaauggguccuguuucaccauuaugacggacggaccgagcgauggccaagccucuuacaagaucuuucgcaucgaaaaaggcaagauugugaaaagcgucgagaugaacgcucccaauuaucauuacgaagagugcuccuguuacccugacucuagcgagaucacaugcguuugcagagauaacuggcacggguccaaucggcccugggugagcuucaaccagaaucucgaauaucagauuggauacaucuguucuggcauuuuuggggacaacccucgcccccaugauaagaccggauccugcggcccggugagcucuaauggggccaacggagucaagggcuucuccuuuaaauauggcaaugggguguggaucggaagaacaaagagcauuuccucucggaaaggcuucgagaugaucugggacccuaacggguggaccggaaccgacaacaauuuuagcaucaagcaggauauuguuggcaucaacgaaugguccggguacucuggcagcuucgugcaacaccccgagcugacaggacuugacuguauucgcccuugcuucugggucgaacugaucagaggccggcccaaagagaauacgauuuggaccuccgggagcucuaucuccuuuuguggagugaacagcgauacaguuggcuggucuuggcccgacggggcugagcucccuuucaccaucgauaaguga

SEQ ID NO: 208739 - RNA, 1410 nt, Artificial Sequence; identical to SEQ ID NO: 205946
  derived and/or modified sequence opt5 from neuraminidase__InfluenzaA__AIL94897

SEQ ID NO: 208740 - RNA, 1410 nt, Artificial Sequence; identical to SEQ ID NO: 208734
  derived and/or modified sequence opt5 from neuraminidase__InfluenzaA__AIL94909

SEQ ID NO: 208741 - RNA, 1410 nt, Artificial Sequence; identical to SEQ ID NO: 205170
  derived and/or modified sequence opt5 from neuraminidase__InfluenzaA__AIL94921

SEQ ID NO: 208742 - RNA, 1410 nt, Artificial Sequence; identical to SEQ ID NO: 205170
  derived and/or modified sequence opt5 from neuraminidase__InfluenzaA__AIL94933

SEQ ID NO: 208743 - RNA, 1410 nt, Artificial Sequence; identical to SEQ ID NO: 208661
  derived and/or modified sequence opt5 from neuraminidase__InfluenzaA__AIL94945

SEQ ID NO: 208744 - RNA, 1410 nt, Artificial Sequence
  derived and/or modified sequence opt5 from neuraminidase__InfluenzaA__AIL94957
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaucugucauuacguacgaaaacaauaccuggguuaaccagacauaugugaauaucagcaacaccaauuucgccgcggggcaguccguggucucugugaaacuugcuggaaacagcucccugugcccuguuagcggcugggccauuuacucuaaggacaauuccgugagaaucgggagcaaaggagaugucuuugugauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggagguuccuagccccuacaacucccgcuuugaaucuguggcuuggagcgccuccgcuugccacgacggaaucaacuggcugacgauuggcaucagcgggccugauucuggagccgucgcggugcugaaguauaauggcaucauuaccgacacaaucaaguccuggaaaaacaauauucucagaacccaagagagcgagugugccugcgugaacgggucuuguuucacaaucaugaccgauggaccgagcgacggccaggcuuccuacaagauuuuucggaucgaaaaaggcaagaucgucaaaucuguugagauggaugcccccaauuaucauuacgaagagugcagcuguuacccugacuccagcgagauuacgugcgugugccgcgauaacuggcacgggucuaauagacccuggguguccuucaaccagaaucuggaauaucagaucggauacauuuguagcggcgucuuuggggacaacccucggcccaaugauaagacaggaucuugcggcccgguguccagcaacggggcuaauggaguuaagggcuucuccuuuaaauauggcaacgggguguggaucggacgcaccaagucuauuagcuccagaaaaggcuucgagaugaucugggacccuaauggguggaacggaacagacaacaauuuuucuauuaagcaagauaucgucggcaucaacgaauggagcggguacuccggcagcuucgugcagcaucccgagcuuaccggacuggacuguauucggccuugcuucuggguugaacucauccgcggcagacccaaagagaauaccauuuggacaucuggguccagcaucucuuuuuguggagugaacuccgauacggucggcuggagcuggcccgacggggccgagcugccuuucaccauugauaaguga

SEQ ID NO: 208745 - RNA, 1410 nt, Artificial Sequence; identical to SEQ ID NO: 208734
  derived and/or modified sequence opt5 from neuraminidase__InfluenzaA__AIL94968

SEQ ID NO: 208746 - RNA, 1410 nt, Artificial Sequence
  derived and/or modified sequence opt5 from neuraminidase__InfluenzaA__AIM55840
augaaccccaaucagaagaucauuaccaucggcagcgugugcaugacaauugggauggccaaccugauccuccaaauuggaaauaucaucuccauuuggaucucucacagcauucaggucggcaaccagucccagaucgagauuuguaaucaaucuguuaucacguacgaaaacaauaccugggugaaccagacauaugugaauauuagcaacaccaauuucgcugccgggcagccugucguguccguuaaacuggcgggaaacucuagccuuugcccgguguccggcugggcuaucuacagcaaggacaauucugucagaaucggguccaaaggagauguguuuguuauucgggagcccuucaucagcuguucuccucuggaaugccgcacauuuuuccucacccagggcgcccugcuuaacgacaagcauuccaauggcacaauuaaagauagaagccccuaucggacccugaugucuuguccuaucggggaggugcccuccccuuacaacagccgcuuugaauccgucgccuggucugcuagcgccugccacgacggaauuaacuggcucacgaucggcaucuccgggccggauagcggagcuguggccgugcugaaguauaauggcauuaucaccgacacaauuaagucuuggagaaacgauauccugcggacccaagaguccgagugugcgugcgucaaugggagcuguuucacaauuaugaccgacggacccucugauggccaggccagcuacaaaaucuuucgcaucgaaaagggcaaaauuguuaaguccguggagaugaacgcuccuaauuaucauuucgaagagugcucuuguuaccccgacagcuccgagaucacgugcgugugcagagauaacuggcacgggagcaaucggccuugggucucuuuuaaccagaaucucgaauaccagauuggauauaucuguuccggcauuuucggggacaacccccgcccgaaugauaaaacaggaagcugcggcccugugucuuccaacggggccaauggaguuaagggcuuuagcuucaaguacggcaacgggguguggaucggaagaaccaaauccauuucuagccggaagggcuuugagaugaucugggaccccaauggguggacaggaaccgacaacaacuucuccaucaaacaagauauugucggcaucaaugaauggucuggguauagcggcuccuucgugcagcauccugagcugaccggacuugacuguauucgccccugcuuuuggguugaacugaucagaggccggcccaaggagaacacaauuuggacgagcgggucuuccaucagcuucuguggagucaauucugauaccgugggcugguccuggccugacggggcugagcucccguuuacaaucgauaaauga

SEQ ID NO: 208747 - RNA, 1410 nt, Artificial Sequence
  derived and/or modified sequence opt5 from neuraminidase__InfluenzaA__AIM55851
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcagaaucguuaaauccguggagaugaaugcuccuaacuaucauuacgaagagugcucuuguuaccccgauagcuccgagaucacaugcgugugccgggacaauuggcacgggagcaaccgcccuugggucucuuucaaucagaaccuggaauaucagauuggauacaucuguuccggcguguuuggggauaaucccagaccgaacgacaagaccggaagcugcggcccuguuucuuccaauggggccaacggagugaaaggcuucagcuuuaaguauggcaauggggucuggauuggacggacaaaguccaucucuagccgcaaaggcuucgagaugauuugggaucccaacggguggaccggaaccgacaacaaguuuuccaucaaacaagacauugugggcaucaaugaauggucuggguacagcggcuccuucguucagcauccugagcuuacaggacuggauuguaucagacccugcuucuggguggaacucauucggggccgccccgaggagaacacgaucuggaccagcgggucuuccauuagcuuuuguggagucaagucugacacagugggcugguccuggccugauggggcugaacugccguucaccaucgacaaauga

SEQ ID NO: 208748 - RNA, 1410 nt, Artificial Sequence
  derived and/or modified sequence opt5 from neuraminidase__InfluenzaA__AIM55862
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuuaagauugaaaaaggcaagaucguuaaauccguggagaugaaugcuccuaacuaucauuacgaagagugcucuuguuaccccgauagcuccgagaucacaugcgugugccgcgacaauuggcacgggagcaacagaccuugggucucuuucaaucagaaccuggaauaucagauuggauacaucuguuccggcguguuuggggauaauccccggccgaacgacaagaccggaagcugcggcccuguuucuuccaauggggccaacggagugaagggcuucagcuuuaaauauggcaauggggucuggauuggacgcacaaaguccaucucuagcagaaaaggcuucgagaugauuugggaucccaacggguggaacggaaccgacaauaacuuuuccaucaagcaagacauugugggcaucaaagaauggucuggguacagcggcuccuucguucagcauccugagcuuaccggacuggauuguauccggcccugcuucuggguggaacucauucgcggcagacccgaggagaauacaaucuggacgagcgggucuuccauuagcuuuuguggagucaacucugacaccgugggcugguccuggccugauggggcugaacugccguucacaaucgacaaguga

SEQ ID NO: 208749 - RNA, 1410 nt, Artificial Sequence
  derived and/or modified sequence opt5 from neuraminidase__InfluenzaA__AIM55873
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcaaaaucguuaaguccguggagaugaaugcuccuaacuaucauuacgaagagugcucuuguuaccccgauagcuccgagaucacaugcgugugcagagacaauuggcacgggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaauuuuuccaucaaacaagacauugugggcaucaaggaauggucuggguacagcggcuccuucguucagcauccugagcuuacaggacuggauuguauccgccccugcuucuggguggaacucauuagaggccggcccgaggagaacacgaucuggaccagcgggucuuccauuagcuuuuguggagucaauucugacacagugggcugguccuggccugauggggcugaacugccguucaccaucgacaaauga

SEQ ID NO: 208750 - RNA, 1410 nt, Artificial Sequence; identical to SEQ ID NO: 208749
  derived and/or modified sequence opt5 from neuraminidase__InfluenzaA__AIM55884

SEQ ID NO: 208751 - RNA, 1410 nt, Artificial Sequence; identical to SEQ ID NO: 208749
  derived and/or modified sequence opt5 from neuraminidase__InfluenzaA__AIM55918

SEQ ID NO: 208752 - RNA, 1410 nt, Artificial Sequence
  derived and/or modified sequence opt5 from neuraminidase__InfluenzaA__AIM55929
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaccggggaggugccuagccccuacaacucccgcuuugaaucugucgccuggagcgcuuccgccugccacgacggaaucaacuggcugacaauuggcaucagcgggccugauucuggagcuguggccgugcugaaguauaauggcauuaucaccgacacaaucaaguccuggagaaacaauauucuccggacccaagagagcgagugugcgugcgucaacgggucuuguuucacgaucaugacagauggaccgagcgacggccaggccuccuacaaaauuuuucgcaucgaaaagggcaaaauuguuaagucuguggagaugaaugcucccaacuaucauuacgaagagugcagcuguuacccugauuccagcgagauuaccugcgugugcagagacaauuggcacgggucuaaccggcccugggucuccuucaaucagaaccuggaauaucagaucggauacaucuguagcggcguguuuggggauaauccucgccccaacgacaaaacaggaucuugcggcccgguuuccagcaauggggccaacggagugaagggcuucuccuuuaaguauggcaauggggucuggaucggaagaaccaaaucuauuagcucccggaagggcuucgagaugaucugggauccuaacggguggaccggaacagacaacaauuuuucuauuaaacaagacaucgugggcauuaaggaauggagcggguacuccggcagcuucguucagcaucccgagcuuacgggacuggauuguauccgcccuugcuucuggguggaacucaucagaggccggcccgaggagaacaccauuuggacaucuggguccagcaucucuuuuuguggagucaauuccgacaccgugggcuggagcuggcccgauggggcugaacugccuuucacaauugacaaauga

SEQ ID NO: 208753 - RNA, 1410 nt, Artificial Sequence
  derived and/or modified sequence opt5 from neuraminidase__InfluenzaA__AIM55940
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcuccacaaacuucgcugccgggcagucugucgugccuguuaaacuugcgggaaauagcucccugugcccggugagcggcugggcuaucuacucuaaggacaacuccgucagaauugggagcaaaggagauguguuuguuauccgggagcccuucaucucuuguuccccucucgaaugccgcaccuuuuuccugacacagggcgcccuucugaaugacaagcauagcaacggcaccauuaaagauagaucucccuaucggacgcucauguccuguccuaucggggaggugcccagcccuuacaauucccgcuuugaaucugucgccuggagcgcuuccgccugccacgacggaauuaacuggcugaccaucggcauuagcgggccggauucuggagcuguggccgugcugaaguauaacggcaucaucacagacaccauuaaguccuggagaaauaacauccuccggacacaagagagcgagugugcgugcgucaaugggucuuguuucaccauuaugacggauggacccagcgacggccaggccuccuacaaaaucuuucgcauugaaaagggcaaaaucguuaagucuguggagaugaacgcuccuaauuaucauuacgaagagugcagcuguuaccccgauuccagcgagaucacaugcgugugcagagacaacuggcacgggucuaaucggccuugggucuccuucaaccagaaucuggaauaucagauuggauacaucuguagcggcguguuuggggauaacccccgcccgaaugacaaaaccggaucuugcggcccuguuuccagcaacggggccaauggagugaagggcuucuccuuuaaguauggcaacggggucuggauuggaagaacaaaaucuaucagcucccggaagggcuucgagaugauuugggaucccaauggguggaccggaaccgacaacaacuuuucuaucaaacaagacauugugggcaucaaggaauggagcggguacuccggcagcuucguucagcauccugagcuuacaggacuggauuguauccgccccugcuucuggguggaacucauuagaggccggcccgaggagaauacgaucuggaccucuggguccagcauuucuuuuuguggagucaacuccgacacagugggcuggagcuggccugauggggcugaacugccguucaccaucgacaaauga

SEQ ID NO: 208754 - RNA, 1410 nt, Artificial Sequence
  derived and/or modified sequence opt5 from neuraminidase__InfluenzaA__AIM55965
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcaaaaucguuaaguccguggagaugaaugcuccuaacuaucauuacgaagagugcucuuguuaccccgauagcuccgagaucacaugcgugugcagagacaauuggcacgggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaauuuuuccaucaaacaagacauugugggcaucaaggaauggucuggguacagcggcuccuucguucagcauccugagcuuacaggacuggauuguauccgccccugcuucuggguggaacucauuagaggccggcccgaggagaacacgaucuggaccagcgggucuuccauuagcuuuuguggagucaauucugacgcugugggcugguccuggccugauggggccgaacugccguucacaaucgacaaauga

SEQ ID NO: 208755 - RNA, 1410 nt, Artificial Sequence
  derived and/or modified sequence opt5 from neuraminidase__InfluenzaA__AIM55976
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucugucgccuggagcgcuuccgccugccacgacggaauuaacuggcugaccaucggcauuagcgggccugauucuggagcuguggccgugcugaaguauaauggcaucaucacagacaccauuaaguccuggagaaacaauauccuccggacacaagagagcgagugugcgugcgucaacgggucuuguuucaccauuaugacggauggaccgagcgacggccaggccuccuacaaaaucuuucgcauugaaaagggcaaaaucguuaagucuguggagaugaaugcucccaacuaucauuacgaagagugcagcuguuacccugauuccagcgagaucacaugcgugugcagagacaauuggcacgggucuaaccggcccugggucuccuucaaucagaaccuggaauaucagauuggauacaucuguagcggcguguuuggggauaauccucgccccaacgacaaaaccggaucuugcggcccgguuuccagcaauggggccaacggagugaagggcuucuccuuuaaguauggcaauggggucuggauuggaagaacaaaaucuaucagcucccggaagggcuucgagaugauuugggauccuaacggguggaccggaaccgacaacaauuuuucuaucaaacaagacauugugggcaucaaggaauggagcggguacuccggcagcuucguucagcaucccgagcuuacaggacuggauuguauccgcccuugcuucuggguggaacucauuagaggccggcccgaggagaacacgaucuggaccucuggguccagcauuucuuuuuguggagucaauuccgacacagugggcuggagcuggcccgauggggcugaacugccuuucaccaucgacaaauga

SEQ ID NO: 208756 - RNA, 1410 nt, Artificial Sequence
  derived and/or modified sequence opt5 from neuraminidase__InfluenzaA__AIM55987
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaccggggaggugccuagccccuacaacucccgcuuugaaucugucgccuggagcgcuuccgccugccacgacggaaucaacuggcugacaauuggcaucagcgggccugauucuggagcuguggccgugcugaaguauaauggcauuaucaccgacacaaucaaguccuggagaaacaauauucuccggacccaagagagcgagugugcgugcgucaacgggucuuguuucacgaucaugacagauggaccgagcgacggccaggccuccuacaaaauuuuucgcaucgaaaagggcaaaauuguuaagucuguggagaugaaugcucccaacuaucauuacgaagagugcagcuguuacccugauuccagcgagauuaccugcgugugcagagacaauuggcacgggucuaaccggcccugggucuccuucaaucagaaccuggaauaucagaucggauacaucuguagcggcguguuuggggauaauccucgccccaacgacaaaacaggaucuugcggcccgguuuccagcaauggggccaacggagugaagggcuucuccuuuaaguauggcaauggggucuggaucggaagaaccaaaucuauuagcucccggaagggcuucgagaugaucugggauccuaacggguggaccggaacagacaacaauuuuucuauuaaacaagacaucgugggcauuaaggaauggagcggguacuccggcagcuucguucagcaucccgagcuuacgggacuggauuguauccgcccuugcuucuggguggaacucaucagaggccggcccgaggagaacaccauuuggacaucuggguccagcaucucuuuuuguggagucaauuccgacaccguggauuggagcuggcccgacggcgcugaacugccuuucacaauugauaaauga

SEQ ID NO: 208757 - RNA, 1410 nt, Artificial Sequence
  derived and/or modified sequence opt5 from neuraminidase__InfluenzaA__AIM55998
augaaccccaaucagaagaucauuaccaucggcagcgugugcaugacaauugggauggccaaccugauccuccaaauuggaaauacgaucuccaucugggucucucacagcauucagcugggcaaccagucccagaucgagaccuguaaucaaucuguuauuacauacgaaaacaauaccugggugaaccagacauaugugaauaucagcaacaccaauuucgcugccgggcaguccgucgugccuguuaaacuugcgggaaacucuagccugugcccgguguccggcugggcuauuuacagcaaggacaauucugucagaaucggguccaaaggagauguguuuguuauucgggagcccuucaucagcuguucuccucucgaaugccgcacauuuuuccugacccagggcgcccuucugaacgacaagcauuccaauggcacgaucaaagauagaagccccuaucggacccucaugucuuguccuauuggggaggugcccuccccuuacaacagccgcuuugaauccgucgccuggucugcuagcgccugccacgacggaaucaacuggcugacaauuggcaucuccgggccggauagcggagcuguggccgugcugaaguauaauggcauuaucaccgacacaaucaagucuuggagaaacaauauucuccggacccaagaguccgagugugcgugcgucaacgggagcuguuucacgaucaugacagauggacccucugacggccaggccagcuacaaaauuuuucgcaucgaaaagggcaaaauuguuaaguccguggagaugaaugcuccuaacuaucauuacgaagagugcucuuguuaccccgauagcuccgagauuaccugcgugugcagagacaauuggcacgggagcaaccggccuugggucucuuucaaucagaaccuggaauaucagaucggauacaucuguuccggcguguuuggggauaauccccgcccgaacgacaaaacaggaagcugcggcccuguuucuuccaauggggccaacggagugaagggcuucagcuuuaaguauggcaauggggucuggaucggaagaaccaaauccauuucuagccggaagggcuucgagaugaucugggaucccaacggguggaccggaacagacaacaaauuuuccauuaagcaagacaucgugggcauuaaugaauggucuggguacagcggcuccuucguucagcauccugagcuuacgggacuggauuguauccgccccugcuucuggguggaacucaucagaggccggcccgaggagaacaccauuuggacaagcgggucuuccaucagcuuuuguggagucaaaucugacaccgugggcugguccuggccugauggggcugaacugccguucacaauugacaaguga

SEQ ID NO: 208758 - RNA, 1410 nt, Artificial Sequence; identical to SEQ ID NO: 208755
  derived and/or modified sequence opt5 from neuraminidase__InfluenzaA__AIM56009

SEQ ID NO: 208759 - RNA, 1410 nt, Artificial Sequence; identical to SEQ ID NO: 208755
  derived and/or modified sequence opt5 from neuraminidase__InfluenzaA__AIM56020

SEQ ID NO: 208760 - RNA, 1410 nt, Artificial Sequence; identical to SEQ ID NO: 208755
  derived and/or modified sequence opt5 from neuraminidase__InfluenzaA__AIM56031

SEQ ID NO: 208761 - RNA, 1410 nt, Artificial Sequence
  derived and/or modified sequence opt5 from neuraminidase__InfluenzaA__AIM56042
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucuaauggccaggccagcuacaaaaucuuucgcauugaaaagggcaaaaucguuaaguccguggagaugaacgcuccuaauuaucauuacgaagagugcucuuguuaccccgacagcuccgagaucacaugcgugugcagagauaacuggcacgggagcaaucggccuugggucucuuucaaccagaaucuggaauaucagauuggauacaucuguuccggcguguuuggggacaacccccgcccgaaugauaaaaccggaagcugcggcccuguuucuuccaacggggccaauggagugaagggcuucagcuuuaaguauggcaacggggucuggauuggaagaacaaaauccaucucuagccggaagggcuucgagaugauuugggaccccaacggguggaccggaaccgauaauaacuuuuccaucaaacaagacauugugggcaucaaggaauggucuggguacagcggcuccuucguucagcauccugagcuuacaggacuggacuguauccgccccugcuucuggguggaacucauuagaggccggcccgaggagaauacgaucuggaccagcgggucuuccauuagcuuuuguggagucaacucugauacagugggcugguccuggccugacggggcugaacugccguucaccaucgauaaauga

SEQ ID NO: 208762 - RNA, 1410 nt, Artificial Sequence
  derived and/or modified sequence opt5 from neuraminidase__InfluenzaA__AIM56053
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucugucgccuggagcgcuuccgccugccacgacggaauuaacuggcugaccaucggcauuagcgggccugauucuggagcuguggccgugcugaaguauaauggcaucaucacagacaccauuaaguccuggagaaacaauauccuccggacacaagagagcgagugugcgugcgucaacgggucuuguuucaccauuaugacggauggaccgagcgacgaacaggccuccuacaaaaucuuucgcauugagaagggcaaaaucguuaagucuguggaaaugaaugcucccaacuaucauuacgaggagugcagcuguuacccugauuccagcgaaaucacaugcgugugcagagacaauuggcacggcucuaaccggcccugggucuccuucaaucagaaccuggaguaucagauuggguacaucuguagcggaguguuuggcgauaauccucgccccaacgacaaaaccgggucuugcggaccgguuuccagcaauggcgccaacggggugaagggauucuccuuuaaguauggcaauggcgucuggauugggagaacaaaaucuaucagcucccggaagggauucgaaaugauuugggauccuaacggcuggaccgggaccgacaacaauuuuucuaucaaacaagacauugugggaaucaaggaguggagcggcuacuccgggagcuucguucagcaucccgaacuuacaggccuggauuguauccgcccuugcuucuggguggagcucauuagaggacggcccgaggaaaacacgaucuggaccucuggcuccagcauuucuuuuuguggggucaauuccgacacagugggauggagcuggcccgauggcgcugagcugccuuucaccaucgacaaauga

SEQ ID NO: 208763 - RNA, 1410 nt, Artificial Sequence
  derived and/or modified sequence opt5 from neuraminidase__InfluenzaA__AIM56064
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcaaaaucguuaaguccguggagaugaaugcuccuaacuaucauuacgaagagugcucuuguuaccccgauagcuccgagaucacaugcgugugcagagacaauuggcacgggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaauuuuuccaucaaacaagacauugugggcaucaaggaauggucuggguacagcggcuccuucguucagcauccugagcuuacaggacuggauuguauccgccccugcuucuggguggaacucgucagaggccggcccgaggagaacacgauuuggaccagcgggucuuccaucagcuuuuguggagucaauucugacacagugggcugguccuggccugauggggcugaacugccguucaccauugacaaauga

SEQ ID NO: 208764 - RNA, 1410 nt, Artificial Sequence
  derived and/or modified sequence opt5 from neuraminidase__InfluenzaA__AIM56086
augaaccccaaucagaagaucauuaccaucggcagcgugugcaugacaauugggauggccaaccugauccuccaaauuggaaauaucaucuccauuugggucucucacagcauccagcugggcaaccagucccauauugagacguguaaucagucuguuaucaccuacgaaaacaauacaugggugaaccaaaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcacuccaauggcaccauuaaagauagaagccccuaucggacgcucaugucuuguccuaucggggaggugcccuccccuuacaacagccgcuuugaauccgucgccuggucugcuagcgccugccaugacggaauuaacuggcugaccaucggcauuuccgggccggauaauggagcuguggccgugcugaaguauaacggcaucaucacagacaccauuaagagcuggagaaauaacauccuccggacacaggagucugagugugcgugcgucaauggguccuguuucaccauuaugacggauggacccagcgacggccaagccucuuacaaaaucuuucgcauugaaaagggcaaaaucguuaagagcguggagaugaacgcuccuaauuaucacuacgaagagugcuccuguuaccccgauucuagcgagaucacaugcgugugcagagacaacuggcauggguccaaucggccuugggucagcuucaaccagaaucuggaauaucagauuggauacaucuguucuggcguguuuggggauaacccccgcccgaaugacaaaaccggauccugcggcccuguuacaagcaacggggccaauggagugaagggcuucucuuuuaaguauggcaacggggucuggauuggaagaaccaaauccaucagcucccggaagggcuucgagaugauuugggaucccaacggguggaccggaacagacaauaacuuuucuaucaaacaggacauuaucggcaucaaggaauggagcggguacuccggcucuuucgugcaacacccugagcuuacgggacuggauuguauucgccccugcuucuggguugaacucaucagaggccggcccgaggagaauaccauuuggacaagcggguccagcaucucuuuuuguggagugaacuccgacaccgucggcuggagcuggccugauggggcugaacugccguucacaauugacaaauga

SEQ ID NO: 208765 - RNA, 1410 nt, Artificial Sequence
  derived and/or modified sequence opt5 from neuraminidase__InfluenzaA__AIM56097
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgagcaguccgucgugucuguuaaacuugcggggaacagcucccugugcccugugagcggaugggcuaucuacucuaaggacaauuccgucagaauuggcagcaaaggggauguguuuguuauccgggaaccguucaucucuuguagcccccucgagugccgcaccuuuuuccugacacagggagcccuucugaacgacaagcauuccaauggcaccauuaaagauagaucuccuuaucggacgcucauguccugucccaucggcgaagugccuagccccuacaacucccgcuuugagucugucgccuggagcgcuuccgccugccacgacgggauuaacuggcugaccaucggaauuagcggcccugauucuggggcuguggccgugcugaaguauaauggaaucaucacagacaccauuaaguccuggagaaacaauauccuccggacacaagagagcgaaugugcgugcgucaacggcucuuguuucaccauuaugacggaugggccgagcgacggacaggccuccuacaaaaucuuucgcauugagaagggcaaaaucguuaagucuguggaaaugaaugcucccaacuaucauuacgaggagugcagcuguuacccugauuccagcgaaaucacaugcgugugcagagacaauuggcacggcucuaaccggcccugggucuccuucaaucagaaccuggaguaucagauuggguacaucuguagcggaguguuuggcgauaauccucgccccaacgacaaaaccgggucuugcggaccgguuuccagcaauggcgccaacggggugaagggauucuccuuuaaguauggcaauggcgucuggauugggagaacaaaaucuaucagcucccggaagggauucgaaaugauuugggauccuaacggcuggaccgggaccgacaacaauuuuucuaucaaacaagacauugugggaaucaaggaguggagcggcuacuccgggagcuucguucagcaucccgaacuuacaggccuggauuguauccgcccuugcuucuggguggagcucauuagaggacggcccgaggaaaacacgaucuggaccucuggcuccagcauuucuuuuuguggggucaauuccgacacagugggauggagcuggcccgauggcgcugagcugccuuucaccaucgacaaauga

SEQ ID NO: 208766 - RNA, 1410 nt, Artificial Sequence
  derived and/or modified sequence opt5 from neuraminidase__InfluenzaA__AIM56108
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacauggauuaaccagaccuaugugaauaucagcaacacaaauuucgcugccgggcaguccguggucccugugaaacuugcgggaaacucuagccugugcccgguuuccggcugggcuauuuacagcaaggacaauucugugagaaucggguccaaaggagaugucuuugugauccgggagcccuucauuagcuguucuccucucgaaugccgcaccuuuuuccugacacagggcgcccuucugaacgacaagcauuccaauggcaccaucaaagauagaagccccuaucggacgcucaugucuuguccuauuggggagguucccuccccuuacaacagccgcuuugaauccguggccuggucugcuagcgccugccacgacggaaucaacuggcugaccauuggcaucuccgggccggauagcggagcugucgccgugcugaaguauaauggcaucauuacagacaccaucaagucuuggagaaacaauauucuccggacacaagaguccgagugugcgugcgugaacgggagcuguuucaccaucaugacggauggacccucugacggccaggccagcuacaaaauuuuucgcaucgaaaagggcaaaaucgucaaguccguugagaugaaugcuccuaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcgucuuuggggauaauccccgcccgaacgacaaaaccggaagcugcggcccugugucuuccaauggggccaacggaguuaagggcuucagcuuuaaguauggcaaugggguguggaucggaagaacaaaauccauuucuagccggaagggcuucgagaugaucugggaucccaacggguggaccggaaccgacaacaauuuuuccauuaaacaagacaucgucggcaucaaggaauggucuggguacagcggcuccuucgugcagcauccugagcuuacaggacuggauuguauucgccccugcuucuggguugaacucaucagaggccggcccgaggagaacacgauuuggaccagcgggucuuccaucagcuuuuguggagucaauucugacacagugggcugguccuggccugauggggcugaacugccguucaccauugacaaauga

SEQ ID NO: 208767 - RNA, 1410 nt, Artificial Sequence
  derived and/or modified sequence opt5 from neuraminidase__InfluenzaA__AIM56119
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuucaaucagaaccucgaauaucagaucggauacauuuguagcggcguguuuggggauaauccucgccccaacgacaaaaccggaucuugcggcccgguuuccagcaauggggccaacggagugaagggcuucuccuuuaaguauggcaauggggucuggaucggaagaacaaaaucuauuagcucccggaagggcuucgagaugaucugggauccuaacggguggaccggaaccgacaacaaauuuucuauuaagcaagacaucgugggcaucaaugaauggagcggguacuccggcagcuucguucagcaucccgagcugacaggacuugauuguauucgcccuugcuucuggguggaacugaucagaggccggcccgaggagaacacgauuuggaccucuggguccagcaucucuuuuuguggagucaauuccgacacagugggcuggagcuggcccgauggggcugaacucccuuucaccauugacaaauga

SEQ ID NO: 208768 - RNA, 1410 nt, Artificial Sequence
  derived and/or modified sequence opt5 from neuraminidase__InfluenzaA__AIM56130
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcaaaaucguuaaguccguggagaugaaugcuccuaacuaucauuacgaagagugcucuuguuaccccgauagcuccgagaucacaugcgugugcagagacaauuggcacgggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaaauuuuccaucaagcaagacauugugggcaucaaugaauggucuggguacagcggcuccuucguucagcauccugagcuuacaggacuggauuguauccgccccugcuucuggguggaacucauuagaggccggcccgaggagaacacgaucuggaccagcgggucuuccauuagcuuuuguggagucaaaucugacacagugggcugguccuggccugauggggcugaacugccguucaccaucgacaaguga

SEQ ID NO: 208769 - RNA, 1410 nt, Artificial Sequence
  derived and/or modified sequence opt5 from neuraminidase__InfluenzaA__AIM56141
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucauuuacgaaaacaauaccugggugaaccagacauaugugaauaucagcaacaccaauuucgcugccgggcaguccgucgugucuguuaaacuugcgggaaacagcucccugugcccugugagcggcugggcuauuuacucuaaggacaauuccgucagaaucgggagcaaaggagauguguuuguuauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggaggugccuagccccuacaacucccgcuuugaaucugucgccuggagcgcuuccgccugccacgacggaaucaacuggcugacgauuggcaucagcgggccugauucuggagcuguggccgugcugaaguauaauggcaucauuaccgacacaaucaaguccuggagaaacaauauucuccggacccaagagagcgagugugcgugcgucaacgggucuuguuucacaaucaugaccgauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacgugcgugugcagagacaauuggcacgggucuaaccggcccugggucuccuucaaucagaaccuggaauaucagaucggauacauuuguagcggcguguuuggggauaauccucgccccaacgacaaaacaggaucuugcggcccgguuuccagcaauggggccaacggagugaagggcuucuccuuuaaguauggcaauggggucuggaucggaagaaccaaaucuauuagcucccggaagggcuucgagaugaucugggauccuaacggguggacaggaaccgacaacaauuuuucuauuaaacaagacaucgugggcaucaaggaauggagcggguacuccggcagcuucguucagcaucccgagcuuaccggacuggauuguauucgcccuugcuucuggguggaacucaucagaggccggcccgaggagaacacaauuuggacgucuggguccagcaucucuuuuuguggagucaauuccgacaccgugggcuggagcuggcccgauggggcugaacugccuuucacaauugacaaauga

SEQ ID NO: 208770 - RNA, 1410 nt, Artificial Sequence; identical to SEQ ID NO: 208755
  derived and/or modified sequence opt5 from neuraminidase__InfluenzaA__AIM56152

SEQ ID NO: 208771 - RNA, 1410 nt, Artificial Sequence
  derived and/or modified sequence opt5 from neuraminidase__InfluenzaA__AIM56163
augaaccccaaucagaagaucauuaccaucggcagcgugugcaugacaauugggauggccaaccugauccuccaaauuggaaauaucaucuccauuugggucucucacagcauccagcugggcaaccagucccauauugagacguguaaucagucuguuaucaccuacgaaaacaauacaugggugaaccaaaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcacuccaauggcaccauuaaagauagaagccccuaucggacgcucaugucuuguccuaucggggaggugcccuccccuuacaacagccgcuuugaauccgucgccuggucugcuagcgccugccaugacggaauuaacuggcugaccaucggcauuuccgggccggauaauggagcuguggccgugcugaaguauaacggcaucaucacagacaccauuaagagcuggagaaauaacauccuccggacacaggagucugagugugcgugcgucaauggguccuguuucaccauuaugacggauggacccagcgacggccaagccucuuacaaaaucuuucgcauugaaaagggcaaaaucguuaagagcguggagaugaacgcuccuaauuaucacuacgaagagugcuccuguuaccccgauucuagcgagaucacaugcgugugcagagacaacuggcauggguccaaucggccuugggucagcuucaaccagaaucuggaauaucagauuggauacaucuguucuggcguguuuggggauaacccccgcccgaaugacaaaaccggauccugcggcccuguuacaagcaacggggccaauggagugaagggcuucucuuuuaaguauggcaacggggucuggauuggaagaaccaaauccaucagcucccggaagggcuucgagaugauuugggaucccaacggguggaccggaacagacaauaacuuuucuaucaaacaggacauugugggcaucaaggaauggagcggguacuccggcucuuucguucaacacccugagcuuacgggacuggauuguauccgccccugcuucuggguggaacucauuagaggccggcccgaggagaauaccaucuggacaagcggguccagcauuucuuuuuguggagucaacuccgacaccgugggcuggagcuggccugauggggcugaacugccguucacaaucgacaaauga

SEQ ID NO: 208772 - RNA, 1410 nt, Artificial Sequence
  derived and/or modified sequence opt5 from neuraminidase__InfluenzaA__AIM56174
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcaaaaucguuaaguccguggagaugaaugcuccuaacuaucauuacgaagagugcucuuguuaccccgauagcuccgagaucacaugcgugugcagagacaauuggcacgggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaauuuuuccaucaaacaagacauugugggcaucaaggaauggucuggguacagcggcuccuucguucagcauccugagcuuacaggacuggauuguauccgccccugcuucuggguggaacucauuagaggccggcccgaggagaacacgaucuggaccagcgggucuuccauuagcuuuuguggagucaauucugacacagugggcugguccuggccugauggggcugaacugccguucaccgucgacaaauga

SEQ ID NO: 208773 - RNA, 1410 nt, Artificial Sequence; identical to SEQ ID NO: 208768
  derived and/or modified sequence opt5 from neuraminidase__InfluenzaA__AIM56185

SEQ ID NO: 208774 - RNA, 1410 nt, Artificial Sequence; identical to SEQ ID NO: 208767
  derived and/or modified sequence opt5 from neuraminidase__InfluenzaA__AIM56196

SEQ ID NO: 208775 - RNA, 1410 nt, Artificial Sequence; identical to SEQ ID NO: 208749
  derived and/or modified sequence opt5 from neuraminidase__InfluenzaA__AIM56207

SEQ ID NO: 208776 - RNA, 1410 nt, Artificial Sequence
  derived and/or modified sequence opt5 from neuraminidase__InfluenzaA__AIM56229
augaaccccaaucagaagaucauuaccaucggcagcgugugcaugacaauugggauggccaaccugauccuccaaauuggaaauacgaucuccaucugggucucucacagcauucagaucggcaaccagucccagauugagaccuguaaucaaucuguuaucacauacgaaaacaauaccugggugaaccagacauaugugaauauuagcaacaccaauuucgcugccgggcaguccgucgugucuguuaaacuggcgggaaacagcucccuuugcccugugagcggcugggcuaucuacucuaaggacaauuccgucagaauugggagcaaaggagauguguuuguuauccgggagccguucaucucuuguagcccccuggaaugccgcacauuuuuccucacccagggcgcccugcuuaacgacaagcauuccaauggcacgauuaaagauagaucuccuuaucggacccugauguccugucccaucggggaggugccuagccccuacaacucccgcuuugaaucugucgccuggagcgcuuccgccugccacgacggaauuaacuggcucacaaucggcauuagcgggccugauucuggagcuguggccgugcugaaguauaauggcaucaucaccgacacaauuaaguccuggagaaacaauauccugcggacccaagagagcgagugugcgugcgucaacgggucuuguuucacgauuaugacagauggaccgagcgacggccaugccuccuacaaaaucuuucgcauugaaaagggcaaaaucguuaagucuguggagaugaaugcucccaacuaucacuacgaagagugcagcuguuacccugauuccagcgagauuaccugcgugugcagagacaauuggcaugggucuaaccggcccugggucuccuucaaucagaaccucgaauaucagaucggauacaucuguagcggcguguuuggggauaauccucgccccaacgacaaaacaggaucuugcggcccgguuuccagcaauggggccaacggagugaagggcuucuccuuuaaguauggcaauggggucuggauuggaagaaccaaaucuaucagcucccggaagggcuucgagaugauuugggauccuaacggguggaccggaacagacaacaaauuuucuaucaagcaggacauugugggcaucaaugaauggagcggguacuccggcagcuucguucaacaccccgagcugacgggacuugauuguauccgcccuugcuucuggguggaacugauuagaggccggcccgaggagaacaccaucuggacaucuggguccagcauuucuuuuuguggagucaauuccgacaccgugggcuggagcuggcccgauggggcugaacucccuuucacaaucgacaaauga

SEQ ID NO: 208777 - RNA, 1410 nt, Artificial Sequence
  derived and/or modified sequence opt5 from neuraminidase__InfluenzaA__AIM56240
augaaccccaaucagaagaucauuaccaucggcagcgugugcaugacaauugggauggccaaccugauccuccaaauuggaaauaucaucuccauuuggaucucucacagcauucaggucggcaaccagucccagaucgagacguguaaucaaucuguuauuaccuacgaaaacaauacaugggugaaccagaccuaugugaauaucagcaacacaaauuucgcugccgggcagccugucguguccguuaaacuggcgggaaacucuagccuuugcuccgugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacgauauucugcggacacaagagagcgagugugcgugcgucaaugggucuuguuucaccaucaugacggacggaccgagcgauggccaggccuccuacaaaauuuuucgcaucgaaaagggcaaaaucguuaagucuguggagaugaacgcucccaauuaucauuacgaagagugcagcuguuacccugacuccagcgagauuacaugcgugugcagagauaacuggcacgggucuaaucggcccugggucuccuucaaccagaaucucgaauaucagaucggauacauuuguagcggcaucuuuggggacaacccucgccccaaugauaaaaccggaucuugcggcccgguguccagcaacggggccaauggaguuaagggcuucuccuuuaaguauggcaacgggguguggauuggaagaacaaaaucuaucagcucccggaagggcuucgagaugauuugggacccuaauggguggaccggaaccgacaacaacuuuucuaucaaacaagauaucgucggcauuaaugaauggagcggguacuccggcagcuucgugcagcaucccgagcugacaggacuugacuguauccgcccuugcuucuggguugaacugauuagaggccggcccaaggagaacacgaucuggaccucuggguccagcauuucuuuuuguggagucaauuccgauacagugggcuggagcuggcccgacggggcugagcucccuuucaccaucgauaaauga

SEQ ID NO: 208778 - RNA, 1410 nt, Artificial Sequence
  derived and/or modified sequence opt5 from neuraminidase__InfluenzaA__AIM56251
augaaccccaaucagaagaucauuaccaucggcagcgugugcaugacaauugggauggccaaccugauccuccaaauuggaaauaucaucuccauuugggucucucacagcauccagcugggcaaccagucccauauugagacguguaaucagucuguuaucaccuacgaaaacaauacaugggugaaccaaaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcacuccaauggcaccauuaaagauagaagccccuaucggacgcucaugucuuguccuaucggggaggugcccuccccuuacaacagccgcuuugaauccgucgccuggucugcuagcgccugccaugacggaauuaacuggcugaccaucggcauuuccgggccggauagcggagcuguggccgugcugaaguauaauggcaucaucacagacaccauuaagucuuggagaaacaauauccuccggacacaggaguccgagugugcgugcgucaacgggagcuguuucaccauuaugacggauggacccucugacggccaagccagcuacaaaaucuuucgcauugaaaagggcaaaaucguuaaguccguggagaugaaugcuccuaacuaucacuacgaagagugcucuuguuaccccgauagcuccgagaucacaugcgugugcagagacaauuggcaugggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaauuuuuccaucaaacaggacauugugggcaucaaggaauggucuggguacagcggcuccuucguucaacacccugagcuuacaggacuggauuguauccgccccugcuucuggguggaacucauuagaggccggcccgaggagaacacgaucuggaccagcgggucuuccauuagcuuuuguggagucaauucugacacagugggcugguccuggccugauggggcugaacugccguucaccaucgacaaauga

SEQ ID NO: 208779 - RNA, 1410 nt, Artificial Sequence; identical to SEQ ID NO: 208778
  derived and/or modified sequence opt5 from neuraminidase__InfluenzaA__AIM56262

SEQ ID NO: 208780 - RNA, 1410 nt, Artificial Sequence; identical to SEQ ID NO: 208749
  derived and/or modified sequence opt5 from neuraminidase__InfluenzaA__AIM56273

SEQ ID NO: 208781 - RNA, 1410 nt, Artificial Sequence
  derived and/or modified sequence opt5 from neuraminidase__InfluenzaA__AIM56284
augaaccccaaucagaagaucauuaccaucggcagcgugugcauuacaaucgggauggccaaccugauucuccaaaucggaaauaucauuuccaucugggucucucacagcauucagaucggcaaccagucccagauugagacguguaaucaaucuguuaucaccuacgaaaacaauacaugggugaaccagaccuaugugaauauuagcaacacaaauuucgcugccgggcaguccgucgugucuguuaaacuggcgggaaacagcucccuuugcccugugagcggcugggcuaucuacucuaaggacaauuccgucagaaucgggagcaaaggagauguguuuguuauucgggagccguucaucucuuguagcccccuggaaugccgcaccuuuuuccucacacagggcgcccugcuuaacgacaagcauuccaauggcaccauuaaagauagaucuccuuaucggacgcugauguccugucccaucggggaggugccuagccccuacaacucccgcuuugaaucugucgccuggagcgcuuccgccugccacgacggaauuaacuggcucaccaucggcaucagcgggccugauucuggagcuguggccgugcugaaguauaauggcauuaucacagacaccauuaaguccuggagaaacaauauccugcggacacaagagagcgagugugcgugcgucaacgggucuuguuucaccauuaugacggauggaccgagcgacggccaggccuccuacaaaaucuuucgcaucgaaaagggcaaaauuguuaagucuguggagaugaaugcucccaacuaucauuacgaagagugcagcuguuacccugauuccagcgagaucacaugcgugugcagagacaauuggcacgggucuaaccggcccugggucuccuucaaucagaaccucgaauaucagauuggauacaucuguagcggcguguuuggggauaauccucgccccaacgacaaaaccggaucuugcggcccgguuuccagcaauggggccaacggagugaagggcuucuccuuuaaguauggcaauggggucuggauuggaagaacaaaaucuaucagcucccggaagggcuucgagaugauuugggauccuaacggguggaccggaaccgacaacaaauuuucuaucaagcaagacgugguuggcaucaaugaauggagcggguacuccggcagcuucgugcagcaucccgagcugacaggacuugauuguauucgcccuugcuucugggucgaacugaucagaggccggcccgaggagaacacgauuuggaccucuggguccagcaucucuuuuuguggagucaauuccgacacagugggcuggagcuggcccgauggggcugaacucccuuucaccauugacaaauga

SEQ ID NO: 208782 - RNA, 1410 nt, Artificial Sequence; identical to SEQ ID NO: 208749
  derived and/or modified sequence opt5 from neuraminidase__InfluenzaA__AIM56295

SEQ ID NO: 208783 - RNA, 1410 nt, Artificial Sequence; identical to SEQ ID NO: 208749
  derived and/or modified sequence opt5 from neuraminidase__InfluenzaA__AIM56306

SEQ ID NO: 208784 - RNA, 1410 nt, Artificial Sequence; identical to SEQ ID NO: 208749
  derived and/or modified sequence opt5 from neuraminidase__InfluenzaA__AIM56317

SEQ ID NO: 208785 - RNA, 1410 nt, Artificial Sequence; identical to SEQ ID NO: 208768
  derived and/or modified sequence opt5 from neuraminidase__InfluenzaA__AIM56339

SEQ ID NO: 208786 - RNA, 1410 nt, Artificial Sequence
  derived and/or modified sequence opt5 from neuraminidase__InfluenzaA__AIM56350
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccgucgccuggucugcuagcgccugccacgacggaauuaacuggcugaccaucggcauuuccgggccggauagcggagcuguggccgugcugaaguauaauggcaucaucacagacaccauuaagucuuggagaaacaauauccuccggacacaagaguccgagugugcgugcgucaacgggagcuguuucaccauuaugacggauggacccucugacggccaggccagcuacaaaaucuuucgcauugaaaagggcaaaaucguuaaguccguggagaugaaugcuccuaacuaucauuacgaagagugcucuuguuaccccgauagcuccgagaucacaugcgugugcagagacaauuggcacgggagcaaccggccuugggucucuuucaaucagaaccuggaauaucagauuggauacaucuguuccggcguguuuggggauaauccccgcccgaacgacaaaaccggaagcugcggcccuguuucuuccaauggggccaacggagugaagggcuucagcuuuaaguauggcaauggggucuggauuggaagaacaaaauccaucucuagccggaagggcuucgagaugauuugggaucccaacggguggaccggaaccgacaacaauuuuuccaucaaacaagacauugugggcaucaaggaauggucuggguacagcggcuccuucguucagcauccugagcuuacaggacuggauuguauccgccccugcuucuggguggaacucauuagaggccggcccgaggagaacacgaucuggaccagcgggucuuccauuagcuuuuguggaaucaauucugacacagucggcugguccuggccugauggggcugaacugccguucaccauugacaaauga

SEQ ID NO: 208787 - RNA, 1410 nt, Artificial Sequence; identical to SEQ ID NO: 208778
  derived and/or modified sequence opt5 from neuraminidase__InfluenzaA__AIM56361

SEQ ID NO: 208788 - RNA, 1410 nt, Artificial Sequence; identical to SEQ ID NO: 208749
  derived and/or modified sequence opt5 from neuraminidase__InfluenzaA__AIM56372

SEQ ID NO: 208789 - RNA, 1410 nt, Artificial Sequence; identical to SEQ ID NO: 208778
  derived and/or modified sequence opt5 from neuraminidase__InfluenzaA__AIM56383

SEQ ID NO: 208790 - RNA, 1410 nt, Artificial Sequence
  derived and/or modified sequence opt5 from neuraminidase__InfluenzaA__AIM56394
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuucaaucagaaccucgaauaucagaucggauacauuuguagcggcaucuuuggggauaauccucgccccaacgacaaaaccggaucuugcggcccgguguccagcaauggggccaacggaguuaagggcuucuccuuuaaguauggcaaugggguguggauuggaagaacaaaaucuaucagcucccggaagggcuucgagaugauuugggauccuaacggguggaccggaaccgacaacaaauuuucuaucaagcaagacaucgucggcauuaaugaauggagcggguacuccggcagcuucgugcagcaucccgagcugacaggacuugauuguauccgcccuugcuucuggguugaacugauuagaggccggcccgaggagaacacgaucuggaccucuggguccagcauuucuuuuuguggagucaauuccgacacagugggcuggagcuggcccgauggggcugaacucccuuucaccaucgacaaauga

SEQ ID NO: 208791 - RNA, 1410 nt, Artificial Sequence; identical to SEQ ID NO: 208767
  derived and/or modified sequence opt5 from neuraminidase__InfluenzaA__AIM56405

SEQ ID NO: 208792 - RNA, 1410 nt, Artificial Sequence
  derived and/or modified sequence opt5 from neuraminidase__InfluenzaA__AIM56416
augaaccccaaucagaagaucauuaccaucggcagcgugugcaugacaauugggauggccaaccugauccuccaaauuggaaauaucaucuccauuugggucucucacagcauccagcugggcaaccagucccauauugagacguguaaucagucuguuaucaccuacgaaaacaauacaugggugaaccaaaccuaugugaauauuagcaacaucaauuucgcugccgggcaguccgucgugccuguuaaacuugcgggaaacucuagccugugcccgguguccggcugggcuauuuacagcaaggacaauucugucagaaucggguccaaaggagauguguuuguuauccgggagcccuucauuagcuguucuccucucgaaugccgcacauuuuuccugacccagggcgcccuucugaacgacaagcacuccaauggcacaaucaaagauagaagccccuaucggacccucaugucuuguccuauuggggaggugcccuccccuuacaacagccgcuuugaauccgucgccuggucugcuagcgccugccaugacggaaucaacuggcugacgauuggcaucuccgggccggauaauggagcuguggccgugcugaaguauaacggcaucauuaccgacacaaucaagagcuggagaaauaacauucuccggacccaggagucugagugugcgugcgucaauggguccuguuucacaaucaugaccgauggacccagcgacggccaagccucuuacaaaauuuuucgcaucgaaaagggcaaaaucguuaagagcguggagaugaacgcuccuaauuaucacuacgaagagugcuccuguuaccccgauucuagcgagauuacgugcgugugcagagacaacuggcauggguccaaucggccuugggucagcuucaaccagaaucuggaauaucagaucggauacauuuguucuggcguguuuggggauaacccccgcccgaaugacaaaacaggauccugcggcccuguuaccagcaacggggccaauggagugaagggcuucucuuuuaaguauggcaacggggucuggaucggaagaacaaaauccauuagcucccggaagggcuucgagaugaucugggaucccaacggguggaccggaaccgacaauaacuuuucuauuaaacaggacaucgugggcaucaaggaauggagcggguacuccggcucuuucguucaacacccugagcuuacaggacuggauuguauucgccccugcuucuggguggaacucaucagaggccggcccgaggagaauacgauuuggaccagcggguccagcaucucuuuuuguggagucaacuccgacacagugggcuggagcuggccugauggggcugaacugccguucaccauugacaaauga

SEQ ID NO: 208793 - RNA, 1410 nt, Artificial Sequence; identical to SEQ ID NO: 208767
  derived and/or modified sequence opt5 from neuraminidase__InfluenzaA__AIM56428

SEQ ID NO: 208794 - RNA, 1410 nt, Artificial Sequence; identical to SEQ ID NO: 208749
  derived and/or modified sequence opt5 from neuraminidase__InfluenzaA__AIM56439

SEQ ID NO: 208795 - RNA, 1410 nt, Artificial Sequence
  derived and/or modified sequence opt5 from neuraminidase__InfluenzaA__AIM56450
augaaccccaaucagaagaucauuaccaucggcagcgugugcaugacaauugggauggccaaccugauccuccaaauuggaaauaucaucuccauuuggaucucucacagcauucaggucggcaaccagucccagaucgagacguguaaucaaucuguuauuaccuacgaaaacaauacaugggugaaccagaccuaugugaauaucagcaacacaaauuucgcugccgggcagccugucguguccguuaaacuggcgggaaacucuagccuuugcccgguguccggcugggcuauuuacagcaaggacaauucugucagagugggguccaaaggagauguuuuugugauccgggagcccuucaucagcuguucuccucuggaaugccgcaccuuuuuccucacacagggcgcccugcuuaacgacaagcauuccaauggcaccauuaaagauagaagccccuaucggacgcugaugucuuguccuaucggggagguccccuccccuuacaacagccgcuuugaauccguggccuggucugcuagcgccugccacgacggaauuaacuggcucaccaucggcauuuccgggccggauagcggagcuguggccguccugaaguauaauggcaucaucacagacaccauuaagucuuggagaaacgauauccugcggacacaagaguccgagugugcgugcguuaaugggagcuguuucaccauuaugacggacggacccucugauggccaggccagcuacaaaaucuuucgcauugaaaagggcaaaaucgugaaguccguggagaugaacgcuccuaauuaucauuacgaagagugcucuuguuaccccgacagcuccgagaucacaugcgucugcagagauaacuggcacgggagcaaucggccuugggugucuuucaaccagaaucucgaauauaaaauuggauacaucuguuccggcauuuuuggggacaacccccgcccgaaugauaagaccggaagcugcggcccuguuucuuccaacggggccaauggagugaagggcuucagcuuuaaauauggcaacggggucuggaucggaagaacaaaguccauuucuagccggaaaggcuucgagaugaucugggaccccaauggguggaccggaaccgacaacaacuuuuccgugaagcaggauauuguuggcaucaaugaauggucuggguacagcggcuccuucgugcaacauccugagcugacaggacuugacuguauccgccccugcuucugggucgaacugauuagaggccggcccaaagagaacacgaucuggaccagcgggucuuccauuagcuuuuguggagucaauucugauacagugggcugguccuggccugacggggcugagcucccguucaccaucgauaaguga

SEQ ID NO: 208796 - RNA, 1410 nt, Artificial Sequence
  derived and/or modified sequence opt5 from neuraminidase__InfluenzaA__AIM56461
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggaaaaacaauauucugagaacacaagagagcgagugugcgugcgucaacgggucuuguuucaccaucaugacggauggaccgagcgacggccaggccuccuacaagauuuuucggaucgaaaaaggcaagaucguuaaaucuguggagaugaaugcucccaacuaucauuacgaagagugcagcuguuacccugauuccagcgagauuacaugcgugugccgcgacaauuggcacgggucuaacagacccugggucuccuucaaucagaaccucgaauaucagaucggauacauuuguagcggcguguuuggggauaauccucggcccaacgacaagaccggaucuugcggcccgguuuccagcaauggggccaacggagugaagggcuucuccuuuaaauauggcaauggggucuggaucggacgcacaaagucuauuagcuccagaaaaggcuucgagaugaucugggauccuaacggguggaccggaaccgacaacaaguuuucuauuaaacaagacaucgugggcguuaaugaauggagcggguacuccggcagcuucgugcagcaucccgagcugacaggacuugauuguauccggccuugcuucugggucgaacugauucgcggcagacccgaggagaacacgaucuggaccucuggguccagcauuucuuuuuguggagucaauuccgacacagugggcuggagcuggcccgauggggcugaacucccuuucaccaucgacaaguga

SEQ ID NO: 208797 - RNA, 1410 nt, Artificial Sequence
  derived and/or modified sequence opt5 from neuraminidase__InfluenzaA__AIM56472
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugcaacgacggaaucaauuggcucaccauuggcaucagcgggccugauucuggagcuguggccgugcugaaguauaacggcaucauuacagacaccaucaaguccuggagaaauaacauucugcggacacaagagagcgagugugcgugcgucaaugggucuuguuucaccaucaugacggauggaccgagcgacggccaggccuccuacaaaauuuuucgcaucgaaaagggcaaaaucguuaagucuguggagaugaacgcucccaauuaucacuacgaagagugcagcuguuacccugauuccagcgagauuacaugcgugugcagagacaacuggcaugggucuaaucggcccugggucuccuucaaccagaaucucgaauaucagaucggauacauuuguagcggcguguuuggggauaacccucgccccaaugacaaaaccggaucuugcggcccgguuuccagcaacggggccaauggagugaagggcuucuccuuuaaguauggcaacggggucuggaucggaagaacaaaaucuauuagcucccggaagggcuucgagaugaucugggauccuaacggguggaccggaaccgacaauaaauuuucuauuaagcaagacaucgugggcaucaacgaauggagcggguacuccggcagcuucguucagcaccccgagcugacaggacuugauuguauucgcccuugcuucuggguggaacugaucagaggccggcccgaggagaauacgauuuggaccucuggguccagcaucucuuuuuguggagucaacuccgacacagugggcuggagcuggcccgauggggcugaacucccuuucaccauugacaaauga

SEQ ID NO: 208798 - RNA, 1410 nt, Artificial Sequence; identical to SEQ ID NO: 208755
  derived and/or modified sequence opt5 from neuraminidase__InfluenzaA__AIM56483

SEQ ID NO: 208799 - RNA, 1410 nt, Artificial Sequence; identical to SEQ ID NO: 208778
  derived and/or modified sequence opt5 from neuraminidase__InfluenzaA__AIM56494

SEQ ID NO: 208800 - RNA, 1410 nt, Artificial Sequence; identical to SEQ ID NO: 208768
  derived and/or modified sequence opt5 from neuraminidase__InfluenzaA__AIM56505

SEQ ID NO: 208801 - RNA, 1410 nt, Artificial Sequence; identical to SEQ ID NO: 208767
  derived and/or modified sequence opt5 from neuraminidase__InfluenzaA__AIM56516

SEQ ID NO: 208802 - RNA, 1410 nt, Artificial Sequence
  derived and/or modified sequence opt5 from neuraminidase__InfluenzaA__AIM56527
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgagcaguccgucgugucuguuaaacuugcggggaacagcucccugugcccugugagcggaugggcuaucuacucuaaggacaauuccgucagaauuggcagcaaaggggauguguuuguuauccgggaaccguucaucucuuguagcccccucgagugccgcaccuuuuuccugacacagggagcccuucugaacgacaagcauuccaauggcaccauuaaagauagaucuccuuaucggacgcucauguccugucccaucggcgaagugccuagccccuacaacucccgcuuugagucugucgccuggagcgcuuccgccugccacgacgggauuaacuggcugaccaucggaauuagcggcccugauucuggggcuguggccgugcugaaguauaauggaaucaucacagacaccauuaaguccuggagaaacaauauccuccggacacaagagagcgaaugugcgugcgucaacggcucuuguuucaccauuaugacggaugggccgagcgacggacaggccuccuacaaaaucuuucgcauugagaagggcaaaaucguuaagucuguggaaaugaaugcucccaacuaucauuacgaggagugcagcuguuacccugauuccagcgaaaucacaugcgugugcagagacaauuggcacggcucuaaccggcccugggucuccuucaaucagaaccuggaguaucagauuggguacaucuguagcggagugcuuggcgauaauccucgccccaacgacaaaaccgggucuugcggaccgguuuccagcaauggcgccaacggggugaagggauuuuccuucaaguauggcaauggcgucuggauugggagaacaaaaucuaucagcucccggaagggauuugaaauggugugggauccuaacggcuggaccgggaccgacaacaauuucucuauuaaacaagacaucguuggaauuaaggaguggagcggcuacuccgggagcuuugugcagcaucccgaacugacaggccucgauuguauccgcccuugcuucugggucgagcugaucagaggacggcccgaggaaaacacgauuuggaccucuggcuccagcaucucuuucuguggggucaauuccgacacagugggauggagcuggcccgauggcgcugagcuuccuuuuaccauugacaaauga

SEQ ID NO: 208803 - RNA, 1410 nt, Artificial Sequence; identical to SEQ ID NO: 208749
  derived and/or modified sequence opt5 from neuraminidase__InfluenzaA__AIM56538

SEQ ID NO: 208804 - RNA, 1410 nt, Artificial Sequence
  derived and/or modified sequence opt5 from neuraminidase__InfluenzaA__AIM56549
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgaggugacaugcgucugcagagacaauuggcacgggucuaaccggcccuggguguccuucaaucagaaccucgaauaucagauuggauacaucuguagcggcguuuuuggggauaauccucgccccaacgacaaaaccggaucuugcggcccgguguccagcaauggggccaacggagucaagggcuucuccuuuaaguauggcaaugggguguggauuggaagaacaaaaucuaucagcucccggaagggcuucgagaugauuugggauccuaacggguggaccggaaccgacaacaaauuuucuaucaagcaagacauuguuggcaucaaugaauggagcggguacuccggcagcuucgugcagcaucccgagcugacaggacuugauuguauccgcccuugcuucugggucgaacugauuagaggccggcccgaggagaacacgaucuggaccucuggguccagcauuucuuuuuguggagucaauuccgacacagugggcuggagcuggcccgauggggcugaacucccuuucaccaucgacaaauga

SEQ ID NO: 208805 - RNA, 1410 nt, Artificial Sequence
  derived and/or modified sequence opt5 from neuraminidase__InfluenzaA__AIM56560
augaaccccaaucagaagaucauuaccaucggcagcgugugcaugacaauugggauggccaaccugauccuccaaauuggaaauaucaucuccauuugggucucucacagcauccagcugggcaaccagucccauauugagacguguaaucagucuguuaucaccuacgaaaacaauacaugggugaaccaaaccuaugugaauauuagcaacacaaauuucgcugccgggcaguccgucgugccuguuaaacuugcgggaaacucuagccugugcccgguguccggcugggcuauccacagcaaggacaauucugucagaauuggguccaaaggagauguguuuguuauccgggagcccuucaucagcuguucuccucucgaaugccgcaccuuuuuccugacacagggcgcccuucugaacgacaagcauuccaauggcaccauuaaagauagaagccccuaccggacgcucaugucuuguccuaucggggaggugcccuccccuuauaacagccgcuuugaauccgucgccuggucugcuagcgccugccacgacggaauuaacuggcugaccaucggcauuuccgggccggauaauggagcuguggccgugcugaaguacaacggcaucaucacagacaccauuaagagcuggagaaauaacauccuccggacacaggagucugagugugcgugcgucaauggguccuguuucaccauuaugacggauggacccagcgacggccaagccucuuauaaaaucuuucgcauugaaaagggcaaaaucguuaagagcguggagaugaacgcuccuaauuaccauuaugaagagugcuccuguuaccccgauucuagcgagaucacaugcgugugcagagacaacuggcacggguccaaucggccuugggucagcuucaaccagaaucuggaauaccagauuggauauaucuguucuggcguguuuggggauaacccccgcccgaaugacaaaaccggauccugcggcccuguuacaagcaacggggccaauggagugaagggcuucucuuuuaaguacggcaacggggucuggauuggaagaaccaaauccaucagcucccggaagggcuucgagaugauuugggaucccaacggguggaccggaacagacaauaacuuuucuaucaaacaggacauugugggcaucaaggaauggagcggguauuccggcucuuucguucaacacccugagcuuacgggacuggauuguauccgccccugcuucuggguggaacucauuagaggccggcccgaggagaauaccaucuggacaagcggguccagcauuucuuuuuguggagucaacuccgacaccgugggcuggagcuggccugauggggcugaacugccguucacaaucgacaaauga

SEQ ID NO: 208806 - RNA, 1410 nt, Artificial Sequence; identical to SEQ ID NO: 208755
  derived and/or modified sequence opt5 from neuraminidase__InfluenzaA__AIM56571

SEQ ID NO: 208807 - RNA, 1410 nt, Artificial Sequence
  derived and/or modified sequence opt5 from neuraminidase__InfluenzaA__AIM56582
augaaccccaaucagaagaucauuaccaucggcagcgugugcauuacaaucgggauggccaaccugauucuccaaaucggaaauaucauuuccaucugggucucucacagcauucagcugggcaaccagucccagaucgagacguguaaucaaucuguuauuaccuacgaaaacaauacaugggugaaccagaccuaugugaauaucagcaacacaaauuucgcugccgggcaguccgucgugucuguuaaacuugcgggaaacagcucccugugcccugugagcggcugggcuauuuacucuaaggacaauuccgucagaaucgggagcaaaggagauguguuuguuauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggugccuagccccuacaacucccgcuuugaaucugucgccuggagcgcuuccgccugccacgacggaaucaacuggcugaccauuggcaucagcgggccugauucuggagcuguggccgugcugaaguauaauggcaucauuacagacaccaucaaguccuggagaaacaauauucuccggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuucaaucagaaccuggaauaucagaucggauacauuuguagcggcguguuuggggauaauccucgccccaacgacaaaaccggaucuugcggcccgguuuccagcaauggggccaacggagugaagggcuucuccuuuaaguauggcaauggggucuggaucggaagaacaaaaucuauuagcucccggaagggcuucgagaugaucugggauccuaacggguggaccggaaccgacaacaauuuuucuauuaaacaagacaucgugggcaucaaggaauggagcggguacuccggcagcuucguucagcaucccgagcuuacaggacuggauuguauucgcccuugcuucuggguggaacucaucagaggccggcccgaggagaacacgauuuggaccucuggguccagcaucucuuuuuguggagucaauuccgacacagugggcuggagcuggcccgauggggcugaacugccuuucaccauugacaaauga

SEQ ID NO: 208808 - RNA, 1410 nt, Artificial Sequence
  derived and/or modified sequence opt5 from neuraminidase__InfluenzaA__AIM56593
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgagcaguccgucgugucuguuaaacuugcggggaacagcucccugugcccugugagcggaugggcuaucuacucuaaggacaauuccgucagaauuggcagcaaaggggauguguuuguuauccgggaaccguucaucucuuguagcccccucgagugccgcaccuuuuuccugacacagggagcccuucugaacgacaagcauuccaauggcaccauuaaagauagaucuccuuaucggacgcucauguccugucccaucggcgaagugccuagccccuacaacucccgcuuugagucugucgccuggagcgcuuccgccugccacgacgggauuaacuggcugaccaucggaauuagcggcccugauucuggggcuguggccgugcugaaguauaauggaaucaucacagacaccauuaaguccuggagaaacaauauccuccggacacaagagagcgaaugugcgugcgucaacggcucuuguuucaccauuaugacggaugggccgagcgacggacaggccuccuacaaaaucuuucgcauugagaagggcaaaaucguuaagucuguggaaaugaaugcucccaacuaucauuacgaggagugcagcuguuacccugauuccagcgaaaucacaugcgugugcagagacaauuggcacggcucuaaccggcccugggucuccuucaaucagaaccuggaguaucagauuggguacaucuguagcggagugcuuggcgauaauccucgccccaacgacaaaaccgggucuugcggaccgguuuccagcaauggcgccaacggggugaagggauuuuccuucaaguauggcaauggcgucuggauugggagaacaaaaucuaucagcucccggaagggauuugaaaugauuugggauccuaacggcuggaccgagaccgacaacaauuucucuaucaaacaagacauuguggggaucaaggaauggagcggauacuccggcagcuuuguucagcaucccgagcugacagggcucgauuguauccgcccuugcuucuggguggagcugauuagaggccggcccgaagagaacacgaucuggaccucuggauccagcauuucuuucuguggcgucaauuccgacacagugggguggagcuggcccgauggagcugaacuuccuuuuaccaucgacaaauga

SEQ ID NO: 208809 - RNA, 1410 nt, Artificial Sequence
  derived and/or modified sequence opt5 from neuraminidase__InfluenzaA__AIM56604
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacauuaauuucgcugccgggcaguccgucgugucuguuaaacuggcgggaaacagcucccuuugcccugugagcggcugggcuaucuacucuaaggacaauuccgucagaaucgggagcaaaggagauguguuuguuauucgggagccguucaucucuuguagcccccuggaaugccgcacauuuuuccucacccagggcgcccugcuuaacgacaagcauuccaauggcacaauuaaagauagaucuccuuaucggacccugauguccugucccaucggggaggugccuagccccuacaacucccgcuuugaaucugucgccuggagcgcuuccgccugccacgacggaauuaacuggcucacgaucggcaucagcgggccugauucuggagcuguggccgugcugaaguauaauggcauuaucaccgacacaauuaaguccuggagaaacaauauccugcggacccaagagagcgagugugcgugcgucaacgggucuuguuucacaauuaugaccgauggaccgagcgacggccaggccuccuacaaaaucuuucgcaucgaaaagggcaaaauuguuaagucuguggagaugaaugcucccaacuaucauuacgaagagugcagcuguuacccugauuccagcgagaucacgugcgugugcagagacaauuggcacgggucuaaccggcccugggucuccuucaaucagaaccucgaauaucagauuggauacaucuguagcggcguguuuggggauaauccucgccccaacgacaaaacaggaucuugcggcccgguuuccagcaauggggccaacggagugaagggcuucuccuuuaaguauggcaauggggucuggauuggaagaaccaaaucuaucagcucccggaagggcuucgagaugauuugggauccuaacggguggacaggaaccgacaacaaauuuucuaucaagcaagacaucgugggcauuaaugaauggagcggguacuccggcagcuucguucagcaucccgagcugaccggacuugauuguauccgcccuugcuucuggguggaacugauuagaggccggcccgaggagaacacaaucuggacgucuggguccagcauuucuuuuuguggagucaauuccgacaccgugggcuggagcuggcccgauggggcugaacucccuuucacaaucgacaaauga

SEQ ID NO: 208810 - RNA, 1410 nt, Artificial Sequence
  derived and/or modified sequence opt5 from neuraminidase__InfluenzaA__AIM56615
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuauguggacaucagcaauacaaacuucgcugccgggcaguccgucgugucuguuaaacuggcgggaaauagcucccuuugcccugugagcggcugggcuauuuacucuaaggauaacuccgucagaaucgggagcaaaggagacguguuuguuauccgggagccguucauuucuuguagcccccuggaaugccgcaccuuuuuccucacacagggcgcccugcuuaaugauaagcauuccaacggcaccaucaaagacagaucuccuuaucggacgcugauguccugucccauuggggaggugccuagccccuacaauucccgcuuugaaucugucgccuggagcgcuuccgccugccacgauggaaucaacuggcucaccauuggcaucagcgggccugacucuggagcuguggccgugcugaaguauaacggcaucauuacagauaccaucaaguccuggagaaauaacauucugcggacacaagagagcgagugugcgugcgucaaugggucuuguuucaccaucaugacggacggaccgagcgauggccaggccuccuacaaaauuuuucgcaucgaaaagggcaaaaucguuaagucuguggagaugaacgcucccaauuaucauuacgaagagugcagcuguuacccugacuccagcgagauuacaugcgugugcagagauaacuggcacgggucuaaucggcccugggucuccuucaaccagaaucucgaauaucagaucggauacauuuguagcggcguguuuggggacaacccucgccccaaugauaaaaccggaucuugcggcccgguuuccagcaacggggccaauggagugaagggcuucuccuuuaaguauucuaacggcgucuggaucgggagaacaaaaagcauuuccucucggaagggauucgagaugaucugggacccuaauggcuggaccgggaccgacaacaaauuuagcauuaagcaagauaucgugggaaucaacgaaugguccggcuacagcgggucuuucguucagcaucccgagcugacaggccuugacuguauucgcccuugcuucuggguggaacugaucagaggacggcccgaggagaauacgauuuggaccuccggcagcucuaucuccuuuuguggggucaacagcgauacagugggauggucuuggcccgacggcgcugaacucccuuucaccauugauaaauga

SEQ ID NO: 208811 - RNA, 1410 nt, Artificial Sequence; identical to SEQ ID NO: 208804
  derived and/or modified sequence opt5 from neuraminidase__InfluenzaA__AIM56626

SEQ ID NO: 208812 - RNA, 1410 nt, Artificial Sequence; identical to SEQ ID NO: 208749
  derived and/or modified sequence opt5 from neuraminidase__InfluenzaA__AIM56637

SEQ ID NO: 208813 - RNA, 1410 nt, Artificial Sequence; identical to SEQ ID NO: 208755
  derived and/or modified sequence opt5 from neuraminidase__InfluenzaA__AIM56648

SEQ ID NO: 208814 - RNA, 1410 nt, Artificial Sequence
  derived and/or modified sequence opt5 from neuraminidase__InfluenzaA__AIM56659
augaaccccaaucagaagaucauuaccaucggcagcgugugcaugacaauugggauggccaaccugauccuccaaauuggaaauaucaucuccauuugggucucucacagcauccagcugggcaaccagucccauauugagacguguaaucagucuguuaucaccuacgaaaacaauacaugggugaaccaaaccuaugugaauauuagcaacacaaauuucgcugccgggcaguccgucgugccuguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccugacacagggcgcccuucugaacgacaagcacuccaauggcaccauuaaagauagaagccccuaucggacgcucaugucuuguccuaucggggaggugcccuccccuuacaacagccgcuuugaauccgucgccuggucugcuagcgccugccaugacggaauuaacuggcugaccaucggcauuuccgggccggauagcggagcuguggccgugcugaaguauaauggcaucaucacagacaccauuaagucuuggagaaacaauauccuccggacacaggaguccgagugugcgugcgucaacgggagcuguuucaccauuaugacggauggacccucugacggccaagccagcuacaaaaucuuucgcauugaaaagggcaaaaucguuaaguccguggagaugaaugcuccuaacuaucacuacgaagagugcucuuguuaccccgauagcuccgagaucacaugcgugugcagagacaauuggcaugggagcaaccggccuugggucucuuucaaucagaaccuggaauaucagauuggauacaucuguuccggcguguuuggggauaauccccgcccgaacgacaaaauuggaagcugcggcccuguuucuuccaauggggccaacggagugaagggcuucagcuuuaaguauggcaauggggucuggaucggaagaaccaaauccauuucuagccggaagggcuucgagaugaucugggaucccaacggguggacaggaaccgacaacaauuuuuccauuaaacaggacaucgugggcaucaaggaauggucuggguacagcggcuccuucguucaacacccugagcuuaccggacuggauuguauucgccccugcuucuggguggaacucaucagaggccggcccgaggagaaaacaauuuggacgagcgggucuuccaucagcuuuuguggagucaacucugacaccgugggcugguccuggccugauggggcugaacugccguucacaauugacaaguga

SEQ ID NO: 208815 - RNA, 1410 nt, Artificial Sequence
  derived and/or modified sequence opt5 from neuraminidase__InfluenzaA__AIM56670
augaaccccaaucagaagaucauuaccaucggcagcgugugcaugacaauugggauggccaaccugauccuccaaauuggaaauacgaucuccaucugggucucucacagcauucagaucggcaaccagucccagauugagaccuguaaucaaucuguuaucacauacgaaaacaauaccugggugaaccagacauaugugaauauuagcaacaccaauuucgcugccgggcaguccgucgugucuguuaaacuggcgggaaacagcucccuuugcccugugagcggcugggcuaucuacucuaaggacaauuccgucagaauugggagcaaaggagauguguuuguuauccgggagccguucaucucuuguagcccccuggaaugccgcacauuuuuccucacccagggcgcccugcuuaacgacaagcauuccaauggcacgauuaaagauagaucuccuuaucggacccugauguccugucccaucggggaggugccuagccccuacaacucccgcuuugaaucugucgccuggagcgcuuccgccugccacgacggaauuaacuggcucacaaucggcauuagcgggccugauucuggagcuguggccgugcugaaguauaauggcaucaucaccgacacaauuaaguccuggagaaacaauauccugcggacccaagagagcgagugugcgugcgucaacgggucuuguuucacgauuaugacagauggaccgagcgacggccaggccuccuacaaaaucuuucgcauugaaaagggcaaaaucguuaagucuguggagaugaaugcucccaacuaucauuacgaagagugcagcuguuacccugauuccagcgagauuaccugcgugugcagagacaauuggcacgggucuaaccggcccugggucuccuucaaucagaaccucgaauaucagaucggauacaucuguagcggcguguuuggggauaauccucgccccaacgacaaaacaggaucuugcggcccgguuuccagcaauggggccaacggagugaagggcuucuccuuuaaguauggcaauggggucuggauuggaagaaccaaaucuaucagcucccggaagggcuucgagaugauuugggauccuaacggguggaccggaacagacaacaaauuuucuaucaagcaagacauugugggcaucaaugaauggagcggguacuccggcagcuucguucagcaucccgagcugacgggacuugauuguauccgcccuugcuucuggguggaacugauuagaggccggcccgaggagaacaccaucuggacaucuggguccagcauuucuuuuuguggagucaauuccgacaccgugggcuggagcuggcccgauggggcugaacucccuuucacaaucgacaaauga

SEQ ID NO: 208816 - RNA, 1410 nt, Artificial Sequence; identical to SEQ ID NO: 208767
  derived and/or modified sequence opt5 from neuraminidase__InfluenzaA__AIM56703

SEQ ID NO: 208817 - RNA, 1410 nt, Artificial Sequence
  derived and/or modified sequence opt5 from neuraminidase__InfluenzaA__AIM56714
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuucaaucagaaccucgaauaucagaucggauacauuuguagcggcguguuuggggauaauccucgccccaacgacaaaaccggaucuugcggcccgguuccuuccaauggggccaacggagugaagggcuucagcuuuaaguauggcaauggggucuggaucggaagaacaaaauccauuucuagccggaagggcuucgagaugaucugggaucccaacggguggaccggaaccgacaacaaauuuuccauuaagcaagacaucgugggcaucaaugaauggucuggguacagcggcuccuucguucagcauccugagcugacaggacuugauuguauucgccccugcuucuggguggaacugaucagaggccggcccgaggagaacacgauuuggaccagcgggucuuccaucagcuuuuguggagucaauucugacacagugggcugguccuggccugauggggcugaacucccguucaccauugacaaauga

SEQ ID NO: 208818 - RNA, 1410 nt, Artificial Sequence
  derived and/or modified sequence opt5 from neuraminidase__InfluenzaA__AIM56725
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgaggugacaugcgucugcagagacaauuggcacgggucuaaccggcccuggguguccuucaaucagaaccucgaauaucagauuggauacaucuguagcggcauuuuuggggauaauccucgccccaacgacaaaaccggaucuugcggcccgguuuccagcaauggggccaacggagugaagggcuucuccuuuaaguauggcaauggggucuggaucggaagaacaaaaucuauuagcucccggaagggcuucgagaugaucugggauccuaacggguggaccggaaccgacaacaaauuuucuauuaagcaagacaucgugggcaucaaugaauggagcggguacuccggcagcuucguucagcaucccgagcugacaggacuugauuguauucgcccuugcuucuggguggaacugaucagaggccggcccgaggagaacacgauuuggaccucuggguccagcaucucuuuuuguggagucaauuccgacacagugggcuggagcuggcccgauggggcugaacucccuuucaccauugacaaauga

SEQ ID NO: 208819 - RNA, 1410 nt, Artificial Sequence; identical to SEQ ID NO: 208767
  derived and/or modified sequence opt5 from neuraminidase__InfluenzaA__AIM56736

SEQ ID NO: 208820 - RNA, 1410 nt, Artificial Sequence
  derived and/or modified sequence opt5 from neuraminidase__InfluenzaA__AIM56747
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguuccagccuggaaugccgcaccuuuuuccucacacagggcgcccugcuuaacgacaagcauucuaauggcaccaucaaagauagaucccccuaucggacgcugaugagcuguccuauuggggaggugcccuccccuuacaacucucgcuuugaaagcgucgccugguccgcuagcgccugccacgacggaaucaacuggcucaccauuggcaucucugggcccgauuccggagcuguggccgugcugaaguauaauggcaucauuacagacaccaucaagagcuggagaaacaauauucugcggacacaagagucugagugugcgugcgucaacgggagcuguuucaccaucaugacggauggaccuuccgacggccaggccucuuacaaaauuuuucgcaucgaaaagggcaaaaucguuaagagcguggagaugaaugcuccgaacuaucauuacgaagagugcuccuguuaccccgauagcucugagauuacaugcgugugcagagacaauuggcacggguccaaccggccuugggucagcuucaaucagaaccucgaauaucagaucggauacauuuguucuggcguguuuggggauaauccccgcccuaacgacaaaaccggauccugcggccccguuagcuccaauggggccaacggagugaagggcuucucuuuuaaguauggcaauggggucuggaucggaagaacaaaaagcauuuccucucggaagggcuucgagaugaucugggauccgaacggguggaccggaaccgacaacaaauuuagcauuaagcaagacaucgugggcaucaaugaaugguccggguacagcggcucuuucguucagcauccugagcugacaggacuugauuguauucgccccugcuucuggguggaacugaucagaggccggccugaggagaacacgauuuggaccuccgggagcucuaucuccuuuuguggagucaauagcgacacagugggcuggucuuggcccgauggggcugaacuccccuucaccauugacaaauga

SEQ ID NO: 208821 - RNA, 1410 nt, Artificial Sequence; identical to SEQ ID NO: 208804
  derived and/or modified sequence opt5 from neuraminidase__InfluenzaA__AIM56758

SEQ ID NO: 208822 - RNA, 1410 nt, Artificial Sequence; identical to SEQ ID NO: 208767
  derived and/or modified sequence opt5 from neuraminidase__InfluenzaA__AIM56769

SEQ ID NO: 208823 - RNA, 1410 nt, Artificial Sequence
  derived and/or modified sequence opt5 from neuraminidase__InfluenzaA__AIM56780
augaaccccaaucagaagaucauuaccaucggcagcgugugcaugacaauugggauggccaaccugauccuccaaauuggaaauaucaucuccauuugggucucucacagcauccagcugggcaaccagucccagauugggacguguaaucaaucuguuaucaccuacgagaacaauacaugggugaaccagaccuaugugaauauuagcaacacaaauuucgcugccggacaguccgucgugucuguuaaacuugcgggcaacagcucccugugcccugugagcgggugggcuaucuacucuaaggacaauuccgucagaauuggaagcaaaggcgauguguuuguuauccgggaaccguucaucucuuguagcccccucgagugccgcaccuuuuuccugacacagggcgcccuucugaacgacaagcauagcaaugggaccauuaaagauagaucuccuuaucggacgcucauguccugucccaucggagaagugccuagccccuacaacucccgcuuugagucugucgccuggagcgcuuccgccugccacgacggcauuaacuggcugaccaucgggauuagcggaccugauucuggcgcuguggccgugcugaaguauaaugggaucaucacagacaccauuaaguccuggagaaacaauauccuccggacacaagaaagcgagugugcgugcgucaacggaucuuguuucaccauuaugacggauggcccgagcgacggccaggccuccuacaaaaucuuucgcauugagaaggggaaaaucaucaagucuguugaaaugaaugcucccaacuaucauuacgaggaaugcagcuguuacccugauuccagcgagauuacaugcgugugcagagacaauuggcacggaucuaaccggcccuggguguccuucaaucagaaccuggaguaucagaucggcuacauuuguagcggggucuuuggagauaauccucgccccaacgacaaaaccggcucuugcgggccgguguccagcaauggagccaacggcguuaagggcuucuccuuuaaguaugggaauggaguguggaucggcagaacaaaaucuauuagcucccggaagggguucgaaaugaucugggauccuaacggauggaccggcaccgacaacaaauuuucuauuaagcaagacaucgucgggauccaugaguggagcggcuacuccggauccuucgugcagcaccccgaacuuacaggccuggauuguauucgcccuugcuucuggguugagcucaucagagggcggcccgaagagaauacgauuuggaccucuggauccagcaucucuuuuuguggcgugaacuccgacacagucggguggagcuggcccgauggagcugagcugccuuucaccauugacaaauga

SEQ ID NO: 208824 - RNA, 1410 nt, Artificial Sequence
  derived and/or modified sequence opt5 from neuraminidase__InfluenzaA__AIM56791
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucugucgccuggagcgcuuccgccugccacgacggaauuagcuggcugaccaucggcauuucugggccugauuccggagcuguggccgugcugaaguauaacggcaucaucacagacaccauuaagagcuggagaaauaacauccuccggacacaagagucugagugugcgugcgucaaugggagcuguuucaccauuaugacggauggaccguccgacggccaggccucuuacaaaaucuuucgcauugaaaagggcaaaaucguuaagagcguggagaugaacgcucccaauuaucauuacgaagagugcuccuguuacccugauagcucugagaucacaugcgugugcagagacaacuggcacggguccaaucggcccugggucagcuucaaccagaaucuggaauaucagauuggauacaucuguucuggcguguuuggggauaacccucgccccaaugacaaaaccggauccugcggcccgguuagcuccaacggggccaauggagugaagggcuucucuuuuaaguauggcaacggggucuggauuggaagaacaaaaagcaucuccucucggaagggcuucgagaugauuugggauccuaauggguggaccggaaccgacaacaacuuuagcaucaaacaagacauugugggcaucaaggaaugguccggguacagcggcucuuucguucagcaucccgagcuuacaggacuggauuguauccgcccuugcuucuggguggaacucauuagaggccggcccgaggagaauacgaucuggaccuccgggagcucuauuuccuuuuguggagucaacagcgacacagugggcuggucuuggcccgauggggcugaacugccuuucaccaucgacaaauga

SEQ ID NO: 208825 - RNA, 1410 nt, Artificial Sequence
  derived and/or modified sequence opt5 from neuraminidase__InfluenzaA__AIM56813
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacuccaaguuugaaucugucgccuggagcgcuuccgccugccacgacggaaucaacuggcucaccauuggcaucagcgggccugauaauggagcuguggccgugcugaaguauaacggcaucauuacagacaccaucaaaucuuggcgcaauaacauucugagaacacaagaguccgagugugcgugcgucaaugggagcuguuucaccaucaugacggauggaccgucugacggccaggccagcuacaagauuuuucggaucgaaaaaggcaagaucguuaaauccguggagaugaacgcucccaauuaucauuacgaagagugcucuuguuacccugauagcuccgagauuacaugcgugugccgcgacaacuggcacgggagcaauagacccugggucucuuucaaccagaaucucgaauaucagaucggauacauuuguuccggcguguuuggggauaacccucggcccaaugacaagaccggaagcugcggcccgguuucuuccaacggggccaauggagugaagggcuucagcuuuaaauauggcaacggggucuggaucggacgcacaaaguccauuucuagcagaaaaggcuucgagaugaucugggauccuaacggguggaccggaaccgacaauaaguuuuccauuaaacaagacaucgugggcaucaacgaauggucuggguacagcggcuccuucguucagcaucccgagcugacaggacuugauuguauucggccuugcuucuggguggaacugauccgcggcagacccgaggagaauacgauuuggaccagcgggucuuccaucagcuuuuguggagucaacucugacacagugggcugguccuggcccgauggggcugaacucccuuucaccauugacaaguga

SEQ ID NO: 208826 - RNA, 1410 nt, Artificial Sequence
  derived and/or modified sequence opt5 from neuraminidase__InfluenzaA__AIM56824
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucguuaagucuguggagaugaaugcucccaacuaucauuacgaagagugcagcuguuacccugauuccagcgagauuacaugcgugugcagagacaauuggcacgggucuaaccggcccugggucuccuucaaucagaaccucgaauaucagaucggauacauuuguagcggcguguuuggggauaauccucgccccaacgacaaaaccggaucuugcggcccgguuccuuccaauggggccaacggagugaagggcuucagcuuuaaguauuccaauggcgucuggaucgggagaacaaaaucuauuagcucccggaagggauucgagaugaucugggaucccaacggcuggaccgggaccgacaacaaauuuucuauuaagcaagacaucgugggaaucaaugaauggagcggcuacuccgggagcuucguucagcauccugagcugacaggccuugauuguauucgccccugcuucuggguggaacugaucagaggacggcccgaggagaacacgauuuggaccucuggcuccagcaucucuuuuuguggggucaauuccgacacagugggauggagcuggccugauggcgcugaacucccguucaccauugacaaauga

SEQ ID NO: 208827 - RNA, 1398 nt, Artificial Sequence
  derived and/or modified sequence opt5 from neuraminidase__InfluenzaA__AIN76385
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccgggaacgaccaauacaagccagaccauuaucaacaauuacuauaacgagacaaauauuaccaacauccagauggaagagagaacaucccggaauuucaacucucugaccaagggccuuuguacgauuaauagcuggcacaucuacgggaaagacaacgccguccgcauuggagaauccucugauguucuggugaccagagagcccuaugugagcugcgacccugaugaaugucgguuuuacgcccucucccagggcacaaccauccgcggcaagcauagcaaugggacaauccacgacagaucucaauaucgggcucugauuuccuggccccugagcucuccucccaccgucuacaacucccgcguggagugcaucggauggagcucuacguccugucaugauggcaaaagcagaauguccauuugcaucucugggccuaacaauaacgccagcgcuguugugugguauaaucggcgcccggucgccgagauuaacacaugggcgagaaauauccuccggacccaggaauccgagugugugugccacaacggaaucugucccauuguuuucacagacggcagcgccaccgggccugcugauacccgcaucuacuacuuuaaggaaggaaagauucugaaaugggagucucuuacaggcacggccaagcacaucgaggaaugcuccugcuauggcgagagaaccgggauuacauguaccugcaaagacaauuggcagggaagcaaccggcccgugauccagaucgauccugucgcuaugacacauaccucucaauacauuuguagccccgugcugacggacacaccgcgcccuaaugaucccaacaucggcaagugcaaugacccuuaucccgggaacaauaacaauggagugaaaggcuucuccuaccucgauggggccaacaccuggcugggaagaaccauuucuacagcgagccgguccggcuaugaaaugcuuaagguccccaacgcccugaccgacgacagaagcaagccuauccagggccagacaauuguucucaaugcugauuggucuggguacuccggcagcuuuauggacuauugggccgagggagauuguuaccgcgcuugcuucuacguggaacugauccgggggagaccgaaagaggacaaggugugguggacgucuaacuccauugucagcauguguuccucuaccgaguuucugggacaguggaauuggcccgauggcgcccgcaucgaauauuuccucuga

SEQ ID NO: 208828 - RNA, 1410 nt, Artificial Sequence; identical to SEQ ID NO: 197111
  derived and/or modified sequence opt5 from neuraminidase__InfluenzaA__AIP93105

SEQ ID NO: 208829 - RNA, 1410 nt, Artificial Sequence
  derived and/or modified sequence opt5 from neuraminidase__InfluenzaA__AIP93117
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccauuuccaaggaccuucggagcggguacgaaacauuuaaggugaucggaggcuggucuaccccuaauuccaaaagccagguuaacagacaagugauugucgauaauaacaauuggucuggcuauuccgggaucuucagcguggagggaaaguccugcauuaaccgcuguuuuuacgucgagcugauccggggcagaccccaggaaacacgcgugugguggaccucuaauagcauuguuguguucugcgggacguccggaacauauggcaccgggucuuggcccgacggcgcuaacaucaauuuuaugccuaucuga

SEQ ID NO: 208830 - RNA, 1410 nt, Artificial Sequence
  derived and/or modified sequence opt5 from neuraminidase__InfluenzaA__AIR93973
augaaccccaaucagaagaucauuaccaucggcagcgugugcaugacaauugggauggccaaccugauccuccaaauuggaaauaucaucuccauuuggaucucucacagcauucagcugggcuccagaaaccagaucgaggcuuguaaucagucugucauuacguacgaaaacaauaccuggguuaaccaaacauaugugaauaucagcaacaccaauuucgccgcggggcaguccguggucccugugaaacuugcuggaaacucuagccugugcccgguuuccggcugggccauuuacagcaaggacaauucuauccggaucggguccaaaggagauguguuugucauucgcgagcccuucaucagcuguucuccucucgaaugcagaacauuuuuccugacccagggcgcccuucugaacgacaagcauuccaauggcacaauuaaagaucggagccccuaucgcacccucaugucuuguccuaucggggaggugcccuccccuuacaacagcagauuugaauccguugcuuggucugccagcgcuugccacgacggaauuaacuggcugacgaucggcaucuccgggccggauaauggagccguggcgguccugaaguauaacggcauuaucaccgacacaauuaagagcuggcggaauaacauccuccgcacccaggagucugagugugugugcgugaauggguccuguuucacagucaugaccgauggacccagcaacggccaagccucuuacaaaauuuuuagaaucgaaaagggcaaaaucguuaagagcguggagaugaaugcuccuaacuaucauuacgaagagugcuccuguuaccccgacucuagcgagauuacgugcgugugccgggauaauuggcacggguccaaccgcccuugggucagcuucaaucagaaccuggaauaucagaucggauacauuuguucuggcaucuuuggggacaaucccagaccgaacgauaaaacaggauccugcggcccugugagcucuaauggggccaacggaguuaagggcuucuccuuuaaguauggcaacgggguguggauuggacggaccaaaagcaucuccucucgcaauggcuucgagaugauuugggaccccaacggguggacagaaaccgauaauaacuuuagcaucaagcaggacaucgucggaauuaaugagugguccggcuacucugggagcuucgugcaacauccugaacuuaccggccuggacuguaucagacccugcuucuggguugagcucauucggggacgccccaaagagaacacaaucuggacguccggcagcucuauuuccuuuuguggggugaauagcaacaccgucggauggucuuggccugauggcgcugaacugccguucacaaucgacaaguga

SEQ ID NO: 208831 - RNA, 1410 nt, Artificial Sequence
  derived and/or modified sequence opt5 from neuraminidase__InfluenzaA__AIR93984
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagauuaacgcucccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccggucagcucuaacggggccaacggagugaagggcuucuccuuuaaguauggcaaugggguuuggaucggaagaacaaaaagcauuuccucucggaacggcuucgagaugaucugggacccuaauggguggaccggaaccgauaacaauuuuagcaucaagcaagacauugugggcaucaacgaaugguccggguacucuggcagcuucguccagcaucccgagcuuacaggacugggcuguauucgcccuugcuucuggguggaacucaucagagggcggcccaaagagaauacgauuuggaccuccggaagcucuaucuccuuuuguggcguuaacagcgacacagugggguggucuuggcccgauggagcugagcugccuuucaccaucgacaaguga

SEQ ID NO: 208832 - RNA, 1410 nt, Artificial Sequence
  derived and/or modified sequence opt5 from neuraminidase__InfluenzaA__AIR93995
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucccugugaaacuugcgggaaauuccucucugugcccgguuagcggcugggcuaucuacuccaaggacaacagcaucagaauugggucuaaaggagauguguuugucauccgggagcccuucauuuccuguagcccucucgaaugccgcacauuuuuccugacccagggcgcccuucugaaugacaagcauucuaacggcacaaucaaagauagaucccccuaucggacccucaugagcuguccuauuggggaggugcccucuccuuacaacucccgcuuugaaagcguugccugguccgcuucugccugccacgacggaaucaauuggcugacgaucggcauuagcgggccggauaacggagcuguggccguccugaaguauaauggcaucauuaccgacacaaucaaguccuggaaaaacaauauucucagaacccaagagagcgagugugugugcgugaacgggucuuguuucacagucaugaccgauggacccuccaauggccaggcgagcuacaagaucuuucggaucgaaaaaggcaagauuguuaaaucuguggagaugaacgccccuaauuaucauuacgaagagugcagcuguuaccccgacuccucugagaucacgugcgugugccgcgauaacuggcacgggagcaauagaccuugggucuccuucaaccagaaucuggaauaucagauuggauacaucuguagcggcguguuuggggacaacccccggccgaaugauaagacaggaucuugcggcccuguuuccagcaacggggcuaacggagugaagggcuucucuuuuaaauauggcaauggggucuggauuggacgcaccaaguccaucagcuccagaaacggcuucgagaugauuugggaccccaauggguggacaggaaccgauaacaauuuuucuaucaaacaagacaucauuggcaucaacgaauggagcggguacuccggcucuuucgugcagcauccugagcuuaccggaauggacuguauucggcccugcuucuggguugaacugauccgcggcagacccaaggagaauacaauuuggacgagcggguccagcaucucuuuuuguggagugaacuccgauaccgucggcuggagcuggccugacggggccgagcucccguucacaaucgauaaauga

SEQ ID NO: 208833 - RNA, 1401 nt, Artificial Sequence
  derived and/or modified sequence opt5 from neuraminidase__InfluenzaA__AIR94118
augaaccccaaucagaagaucauugccaucggcagcgugucccugauuaucgcuauuaucugccuccugaugcaaaucgccauucuuaccacaacgaugacccugcacuucagacagaacgaguguaauaacucuagcaauaaccaggucaugccuugcgaaccgaucauuaucgagcggaauacaguucaucucaacuccaccacaauugaacgcgagaucugucccaaaguggcggaauacaagaauuggucuaaaccucagugccaaauuaccggguuugcucccuucagcaaggacaacuccaucagacugucugccggaggcgauaucugggugacacgggagccuuaugucagcuguucccuugacaaaugcuaccaguuugcccuggggcagggaaccacgcucaagaauaagcacagcaacggcaccacacaugaucgcacaccccacagaacccugcugaugaaugagcucggggugccuuuccaucugggaaccaaacagguuuguauugcuuggucuuccagcucuugcuaugacggcaaggccuggcuucacaucugugugacgggcgaugacaaaaacgcuacagccuccauuaucuacaaugggaugcuggucgauagcauuggaucuugguccaagaacauccuccggacccaagaaagcgagugcguguguaucaacggcacaugcgcgguugugaugaccgacggguccgccucuggaaaagcugauacccgcguccuguuuauuaaggaaggcaagaucauuaauaucagcccgcuuuccgggagcgcccagcacguggaggagugcucuuguuaucccagauacccugaagugcggugcgucugucgcgacaacuggaaaggauccaauagacccauucuguauaucaacauggcugauuacagcaucgagucuagcuacguuugcuccggccucgugggcgacacaccucggaaugaugacucuagcuccagcucuaacuguaaggaccccaauuccgaacgcggggccccgggagugaaaggcugggcguucgaugacgggaacgaugucuggaugggaagaacgauuaagaauggcagccggucuggguaugagaccuuucgcgugguuaacggauggacaguggccaauuccaaaagccaggucaacagacaggugaucguugacuccgaugacuggucuggcuacagcggcauuuucuccguggaagggaagaaaugcaucaaucgguguuuuuaugucgagcugauuagaggacgcccucaagagccccgggugugguggaccucuaacagcaucauugucuucugcggcacauccgggaccuacggaacgggcagcuggccugauggggcuaauaucaacuuuaugcccaucuga

SEQ ID NO: 208834 - RNA, 1410 nt, Artificial Sequence
  derived and/or modified sequence opt5 from neuraminidase__InfluenzaA__AIT38335
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgacaaaucaggugaugcugugcgaacccaccaucauugagagaaacaucacagaaauuguguaucucaccaauacgaccaucgagaaggaaauuuguccuaaacuggucgaguaccggaacuggagcaagccccagugcaaaaucacaggguucgccccuuuuuccaaggacaauucuauucgccuuagcgcgggaggcgauaucugggugaccagagagcccuauguuuccugugacccugauaagugcuaccaauucgcucuggggcagggaacaacccucaacaaucggcauucuaacgacacggugcacgaucgcacaccguauagaacccugcugaugaaugaacucggcauccccuuucaucuggggacaaaacaggucuguauugccuggagcuccagcucuugccacgacggaaaggccuggcuucauguguguguuaccggccacgaugagaacgcuaccgccuccuucaucuacgacggccggcugguggauagcauugucucuugguccaaacgcauccucagaacacaggaaagcgagugcguguguauugacgggacgugcaccguggucaugacagauggaucugcuuccggccgggccgacacccgcauccuguuuaucaaggaggggaaaauuauccacauuagccaacuuuccggaucugcgcagcauguugaagagugcagcuguuauccuagauaccccggcgugcggugcgugugucgcgauaauuggaagggguccaacagaccuaucgucgacauuaaugugaaggacuacagcaucaacucuuccuauguuugcagcggacuggugggcgauacaccccggaaaaacgacucuuucagcuccucuuacugucucaauccgaacaaugaagagggcgggcacggagucaagggcugggccuuugaugacggggaugacguguggaugggacgcaccaucaacgaaaaacugagaagcggcuaugagacguucaagguuauuaaagggugguccaagccuaauagcaaacugcagaucaacagacaggugauugucgaucggggaaaucgcucuggcuacuccggcaucuuuagcguggaggggaagggaugcauuaaccgguguuucuaugucgaacucaucagaggccgcaagcaagagacagaagugugguggaccucuaauuccauuguuguguuuugcgggaccagcggaacauacggcaccggguccuggcccgacggcgcuaacaucaaucugaugccuaucuga

SEQ ID NO: 208835 - RNA, 1410 nt, Artificial Sequence
  derived and/or modified sequence opt5 from neuraminidase__InfluenzaA__AIT38346
augaaccccaaucagaagaucauuaccaucggcagcauuucccugacaaucgccacgauuugcuuccuccugcaaguggcuauccuugucaccacaguuacccugcacuuuaaacaguucgaguguaacccuacaccgaauaaccaggugaugcucugcgaacccaccgugaucgagagaaauauuacaaagaucgucuaccugaccaacacgaccguggaaaaagagauuuguccuaagcccgccgaauaucggaauuggucuaaaccucagugcaagaucacaggguuugcgcccuucagcaaggacaacuccauucgccuuucugcuggaggcgauaucuggguuaccagagagccuuacgugagcugugccccgaauaaaugcuaucaauuugcccuggggcagggaacaacccucaacaaucggcauuccaacgacacgguccacgaucgcacacccuacagaacccugcugaugaaugagcucggcauuccuuuccaucuggggacaaaacagguguguaucgcuuggucuagcuccagcugccacgacggaaaagccuggcuucauguuugugugaccggccacgauaagaacgcuaccgccucuuuuaucuaugacggccggcuggucgauuccauugggagcuggucuaaaaauauccuccgcacacaggaauccgagugcguguguauuaacggaacgugcaccguggucaugacagacggcagcgcgucugggagagccgauaccaagauccuguucauuaaggaaggaaaaaucauccacauuucccaacuuagcggcuccgcucagcauguugaggagugcucuuguuacccccgguauccuggggugcgcugcguguguagagacaacuggaagggaagcaaucggcccaucgucgauauuaacgugcgcgacuacuccaucguuagcucuuacgugugcuccggccuggucggcgauacaccgagaaagaaugacagcuuuucuagcucccacugucucaacccuaauaacgaagaagggggacauggcgugaaggggugggccuucgacgauggagacgauguuuggaugggccggaccauuucugagaaacugcgcagcggguaugagacguuuaaggugaucaaaggaugguccaagcccaauagcaagcugcagaucaacagacaggucauuguggaccggggcaauagaucuggcuacuccgggaucuucagcgucgaaggaaaaucuugcauuaaccgcuguuuuuauguggagcucauccggggcagaaagcaagagacagaaguuugguggaccuccaauagcauuguggucuucugcgggaccuccggaacauacggcaccgggucuuggccugauggcgcugacaucaaccugaugcccauuuga

SEQ ID NO: 208836 - RNA, 1410 nt, Artificial Sequence
  derived and/or modified sequence opt5 from neuraminidase__InfluenzaA__AIT38361
augaaccccaaucagaagaucauuaccaucggcagcauuucccugacaaucgccacgauuugcuuccucaugcaaguggcuauccuggucaccacaguuacccuucacuuuaaacaguacgaguguaacucuacaccuaauaaccaggugaugcugugcgaaccgaccgugaucgagagaaauauuacaaagaucgucuaucucaccaacacgaccgugguuaaagaagugugucccaagccugccgaguaccggaauuggagcaaaccccagugcaagauuacaggguucgcgccuuuuuccaaggacaacucuauccgccugagcgcuggaggcgauauuugggucaccagagaacccuauguguccugugccccuaauaaaugcuaccaauucgcccuugggcagggaacaacccugaacaaucggcauucuaacgacacgguucacgaucgcacaccguauagaacccuccugaugaaugagcugggcauccccuuucaucucgggacaaaacagguguguauugcuuggagcuccagcucuugcuacgacggaaaggccuggcugcacgucugugugaccggccaugauaagaacgcuaccgccuccuucaucuaugacggccggcuuguggauagcaucgggucuugguccaaaaauauucugcgcacacaggagagcgaaugcgucuguaucaacggaacgugcaccguugugaugacagacggcucugcguccgggagagccgauaccaagauucucuuuaucaaggagggaaaaauuauccacaucagccaacuguccggcucugcucagcacguggaagagugcagcuguuacccucgguaccccgggguccgcugcguguguagagacaacuggaagggauccaaucggccuauuguugauaucaacaugcgcgacuauagcauugugucuuccuacgucugcagcggccuugugggcgauacacccagagagaaugacucuuucagcuccucucauugucugaacccgaauaacgaagaagggggacacggcguuaaagggugggccuuugacgauggagacgauguguggaugggccggaccaucagcgagaagcuccgcuccggguaugagacguucaaagucauuaagggauggagcaaaccuaauucuaagcugcagaucaacagacaggugaucgucgaccggggcaauagauccggcuacagcgggaucuuuucuguggaaggaaaguccugcauuaaccgcuguuucuauguugagcugauucggggcagaaaacaagagacagaagugugguggaccagcaauuccaucgucguguuuugcgggaccucuggaacauacggcaccgggagcuggcccgauggcgcugacauuaaccucaugccuaucuga

SEQ ID NO: 208837 - RNA, 1410 nt, Artificial Sequence
  derived and/or modified sequence opt5 from neuraminidase__InfluenzaA__AIT38375
augaaccccaaucagaagaucauuaccaucggcagcgugugcaugacaauugggauggucaaccugauccuccaaauuggaaauaucaucuccauuuggaucucucacagcauucagcugggcaaccagaaucagaucgagauuuguaaccaauccguuaucacguacgaaaauaacaccugggugaaucagacauaugugaacauuucuaauaccaacuucgccgcugggcagagcgucgugccuguuaaacuugccggaaauuccucucugugcagcguguccggcugggcgaucuacagcaaggacaacucuaucagaauuggguccaaaggagaugucuuugugauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggagguuccuucccccuacaacagccgcuuugaauccguggcuuggucugccagcgcuugccacgacggaaucaauuggcugacgaucggcauuuccgggccugauaacggagccgucgcugugcugaaguauaauggcaucauuaccgacacaaucaagagcuggagaaacaauauucuccggacccaagagucugagugugccugcgugaacggguccuguuucacagucaugaccgauggaccgagcgacggccaggcgucuuacaaaaucuuucgcaucgaaaagggcaaaauuguuaagagcguggagaugaaugcccccaacuaucauuacgaagagugcuccuguuacccugauucuagcgagaucacgugcgugugcagagacaauuggcacggguccaaccggcccugggucagcuucaaucagaaccuggaauaucagauuggauacaucuguucuggcauuuuuggggauaauccucgccccaacgacaaaacaggauccugcggcccggugagcucuaauggggcuaacggaguuaagggcuucuccuuuaaguauggcaacgggguguggaucggaagaaccaaaagcauuuccucucggaauggcuucgagaugaucugggauccuaacggguggacaggaaccgacaauaacuuuagcaucaagcaagacauugucggcaucaaugaaugguccggguacucuggcagcuucgugcagcaucccgagcuuaccggacuggauuguauucgcccuugcuucuggguugaacucaucagaggccggcccaaagagaacacaauuuggacguccgggagcucuaucuccuuuuguggagugaauagcgacaccgucggcuggucuuggcccgauggggccgagcugccuuucacaaucgacaaguga

SEQ ID NO: 208838 - RNA, 1410 nt, Artificial Sequence
  derived and/or modified sequence opt5 from neuraminidase__InfluenzaA__AIT93148
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucugucgccuggagcgcuuccgccugccacgacggaauuaacuggcugaccaucggcauuagcgggccugauucuggagcuguggccgugcugaaguauaauggcaucaucacagacaccauuaaguccuggagaaacaauauccuccggacacaagagagcgagugugcgugcgucaacgggucuuguuucaccauuaugacggauggaccgagcgacggccaggccuccuacaaaaucuuucgcauugaaaagggcaaaaucguuaagucuguggagaugaaugcucccaacuaucauuacgaagagugcagcuguuacccugauuccagcgagaucacaugcgugugcagagacaauuggcacgggucuaaccggcccugggucuccuucaaucagaaccuggaauaucagauuggauacaucuguagcggcguguuuggggauaauccucgccccaacgacaaaaccggaucuugcggcccgguuuccagcaauggggccaacggagugaagggcuucuccuuuaaguauggcaauggggucuggauuggaagaacaaaaucuaucagcucccggaagggcuucgagaugauuugggauccuaacggguggaccggaaccgacaacaaauuuucuaucaagcaagacauugugggcaucaaugaauggagcggguacuccggcagcuucguucagcaucccgagcuuacaggacuggauuguauccgcccuugcuucuggguggaacucauuagaggccggcccgaggagaacacgaucuggaccucuggguccagcauuucuuuuuguggagucaauuccgacacagugggcuggagcuggcccgauggggcugaacugccuuucaccaucgacaaauga

SEQ ID NO: 208839 - RNA, 1410 nt, Artificial Sequence; identical to SEQ ID NO: 201664
  derived and/or modified sequence opt5 from neuraminidase__InfluenzaA__AIU39701

SEQ ID NO: 208840 - RNA, 1410 nt, Artificial Sequence; identical to SEQ ID NO: 199762
  derived and/or modified sequence opt5 from neuraminidase__InfluenzaA__AIU39703

SEQ ID NO: 208841 - RNA, 1410 nt, Artificial Sequence
  derived and/or modified sequence opt5 from neuraminidase__InfluenzaA__AIU39705
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaacaccggaagcugcggcccggucucuuccaauggggccaacggagugaaaggcuucagcuuuaaguauggcaacgggguuuggauuggaagaacaaaguccaucucuagccggaauggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 208842 - RNA, 1413 nt, Artificial Sequence
  derived and/or modified sequence opt5 from neuraminidase__InfluenzaA__AIU46611
augaaccccaaucagaagauuaccugcaucagcgccacaggcaugacgcuguccguggucucuaugcucaucgggauugcuaaccugggacuuaauaucggccugcacuacaaaguuggggacagcaccaacauuaauaucccuaacaugaaugagacauccccgaccacaaccaucauuaacaaucauccccaaaacaauuucacaaacaucaccaauauuaucgugacgagaaacgaagagggacaccuccugaaucuuaccaagccucugugugaagugaacucuuggcauauucucagcaaagauaacgccauccggauuggcgaggacgcgcacaucaucgucacacgcgaacccuaucuguccugcgauccucagggguguagaauguuugcucugucucagggaaccacacuccggggcaagcaugccaauggcaccauucacgaccgcagccccuucagagcccugguguccugggagauggggcaggcuccuagcccguacaacacgcggguugagugcaucggauggucuuccacaagcugucacgauggcauuucucgcauguccaucugcauuagcgggcccaauaacaaugccucugcuguggucugguauggaggcagaccugugaccgaaauccccuccugggccgggaacauccuucggacacaagagagcgaauguguuugccauggaggcauuuguccuguggucaugaccgacggccccgcgaauaaccgcgccgagaccaaaaucauuuacuuuaaggaggggaagaucaaaaagauugaggaacugaaaggagaugcucagcacaucgaagagugcuccuguuauggcgccucugaaaugaucaagugcauuugcagagacaauuggaaaggggcuaaccggccggugaucacaauugauccugagaugaugacgcauaccagcaaguaccucuguuccaagauccugacagacaccagccgccccaaugauccuacaaacggaaauugcgaggcccccauuaccggcgggucucccgacccuggagugaaaggcuucgcguuucuugauggcgaaaacuccuggcuggggagaacgaucagcaaggacucucggagcggauaugagaugcucaaagucccgaaugccgaaacagacacccaguccggcgcuauuucucaccagaucaucguuaacaaccaaaauuggagcggguacuccggagccuucauugauuacugggcuaacaaggaguguuuuaaucccugcuucuauguggaacugauccgcggcagaccuaaagagagcucugugcuguggaccuccaacagcauugucgcccucugugggucuaaggagcggcugggcuccuggagcuggcacgacggagccgaaaucauuuacuuuaaauga

SEQ ID NO: 208843 - RNA, 1410 nt, Artificial Sequence
  derived and/or modified sequence opt5 from neuraminidase__InfluenzaA__AIV09221
augaaccccaaucagaagaucauuaccaucggcagcgugugcaugacaauugggauggccaaccugauccuccaaauuggaaauaucacguccaucuggauuucucacagcauccagauuggcaacagaaaucagaucgaggcuuguaaccaguccgucauuaccuacgaaaauaacacauggguuaaucaaaccuaugugaacaucucuaauacaaacuucgccguggggcagagcgucgugccuguuaaacuggcgggaaauuccucucuuugcccggugagcggcugggcuauuuacuccaaggacaacagcauccggaucgggucuaaaggagaugucuuugugauucgcgagcccuucaucuccuguagcccucuggaaugcagaaccuuuuuccucacacagggcgcccugcuuaaugacaagcauucuaacggcaccauuaaagaucggucccccuaucgcacgcugaugagcuguccuaucggggagguucccucuccuuacaacuccagauuugaaagcguggccugguccgcuucugccugccacgacggaauuaauuggcucaccaucggcaucagcgggccggauaacggagcugucgccgugcugaaguauaauggcauuaucacagacaccauuaaguccuggcggaacaauauccugcgcacacaggagagcgagugugugugcgucaacgggucuuguuucaccguuaugacggauggacccuccaauggccaagcgagcuacaaaauuuuuagaaucgaaaagggcaaaaucgugaagucuguggagaugaacgccccuaauuaucauuacgaagagugcagcuguuaccccgacuccucugagauuacaugcgucugccgggauaacuggcacgggagcaaucgcccuuggguguccuucaaccagaaucucgaauaucagaucggauacauuuguagcggcaucuuuggggacaaccccagaccgaaugauaaaaccggaucuugcggcccuguucccuccaacggggcuaacggagugaagggcuucagcuuuaaguauggcaauggggucuggauuggacggacaaaaucuaucuccagccgcaacggcuucgagaugauuugggacccuaauggguggaccgaaaccgauaacgacuuuuccaucaagcaggacaucgugggaauuaaugaguggucuggcuacagcggguccuucguucaacaucccgaacugacaggccuugauuguaucagacccugcuucuggguggagcugauucggggacgcccuaaagagaacacgaucuggaccucuggcagcuccauuagcuuuuguggggucaauucuaacacaguggacugguccuggccggauggagccgaacuccccuucaccaucgacaaguga

SEQ ID NO: 208844 - RNA, 1410 nt, Artificial Sequence
  derived and/or modified sequence opt5 from neuraminidase__InfluenzaA__AIW60703
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaaaaucaccggguucgccccuuuuuccaaggacaacucuauucgccuuagcgcgggaggcgauaucugggugacaagagagcccuauguuuccugugacccugauaagugcuaccaauucgcucuggggcagggaaccacacucaauaaccggcauucuaaugacaccgugcacgaucgcacgccguauagaacacugcugaugaacgaacucggcguccccuuucaucuggggaccaaacagguguguaucgccuggagcuccagcucuugccacgacggaaaggccuggcuucauguuugugugacaggccacgaugagaaugcuaccgccuccuucauuuacgacggccggcuggucgauagcaucgggucuugguccaaaaagauucuccgcacccaggaaagcgagugcguguguaucaacggaacaugcacgguggucaugaccgacggcucugcuuccgggagagccgauacaaaaauucuguuuaucgaggaaggaaagaucguucacauuagcccucuuuccggcucugcgcaacauguggaggaaugcagcuguuauccccaguacuccggggugcggugcgucugucgcgacaauuggaagggaagcaacagaccuaucguggauauuaacguuaaagacuacucuaucguguccagcuaugucugcucuggccuggugggcgacacaccccggaagaaugauagcuccucuagcucccacugucucaacccgaauaacgaggaagggggacauggcguuaaagggugggccuucgacgauggaaaugacguguggaugggccgcaccauuagcgagaagcugagaucuggguacgagaccuuuaaagucaucggaggcugguccaagccuaacagcaaacugcagaucaaucgccaggugauugucgaucggggcaacagaucuggguauuccggaaucuucagcguggaaggcaagaauugcauuaaccgguguuuuuacguugagcucaucagagggcgcaagcaagaaacggaggugugguggacauccaauucuauugucguguucugcggaaccagcggcaccuaugggacaggcuccuggcccgacggagcugauaucaaccugaugccuauuuga

SEQ ID NO: 208845 - RNA, 1410 nt, Artificial Sequence
  derived and/or modified sequence opt5 from neuraminidase__InfluenzaA__AIW60704
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaaaaucaccggguucgccccuuuuuccaaggacaacucuauucgccuuagcgcgggaggcgauaucugggugacaagagagcccuauguuuccugugacccugauaagugcuaccaauucgcucuggggcagggaaccacacucaauaaccggcauucuaaugacaucgugcacgaucgcaccccguauagaacgcugcugaugaacgaacucggcguccccuuucaucuggggacaaaacagguguguauugccuggagcuccagcucuugccacgacggaaaggccuggcuucauguuugugugaccggccacgaugagaaugcuacagccuccuucaucuacgacggccggcuggucgauagcauugggucuugguccaaaaagauccuccgcacccaggaaagcgagugcguguguauuaacggaaccugcacaguggucaugacggacggcucugcuuccgggagagccgauaccaaaauccuguuuaucgaggaaggaaagauuguucacaucagcccucuuuccggcucugcgcaacauguggaggaaugcagcuguuauccccaguacuccggggugcggugcgucugucgcgacaauuggaagggaagcaacagaccuauuguggauaucaacguuaaagacuacucuauuguguccagcuaugucugcucuggccuggugggcgacacaccccggaagaaugauagcuccucuagcucccacugucucaacccgaauaacgaggaagggggacauggcguuaaagggugggccuucgacgauggaaaugacguguggaugggccgcaccaucagcgagaagcugagaucuggguacgagacauuuaaagucaucggaggcugguccaagccuaacagcaaacugcagauuaaucgccaggugaucgucgaucggggcaacagaucuggguauuccggaauuuucagcguggaaggcaagaauugcaucaaccgguguuuuuacguugagcucauuagagggcgcaagcaagaaaccgaggugugguggacguccaauucuaucgucguguucugcggaacaagcggcaccuaugggaccggcuccuggcccgacggagcugauauuaaccugaugccuaucuga

SEQ ID NO: 208846 - RNA, 1410 nt, Artificial Sequence
  derived and/or modified sequence opt5 from neuraminidase__InfluenzaA__AIW60705
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacuccggggugcgcugcguguguagagacaauuggaagggaagcaaccggccuaucgucgauauuaacgugaaagacuacucuaucguuuccagcuaugugugcucuggccuggucggcgacacaccccgcaagaaugauagcuccucuagcucccacugucucaacccgaauaacgaggaagggggacauggcgugaaagggugggcuuucgacgauggaaaugacguuuggaugggcagaaccauuagcgagaaguuucggucuggguacgagaccuucaaagugaucggaggcugguccaagccuaacagcaaacugcagaucaaucgccaggucauuguggauagaggcaaccggucuggguauuccggaaucuuuagcgucgaaggcaaguccugcauuaauagauguuucuacguggagcugauccgcgggcggaagcaggaaacggagguuugguggacaucuaacagcauuguggucuuuugcggaaccuccggcaccuaugggacaggcucuuggcccgacggagccgauaucaaucucaugccuauuuga

SEQ ID NO: 208847 - RNA, 1410 nt, Artificial Sequence; identical to SEQ ID NO: 208846
  derived and/or modified sequence opt5 from neuraminidase__InfluenzaA__AIW60706

SEQ ID NO: 208848 - RNA, 1410 nt, Artificial Sequence
  derived and/or modified sequence opt5 from neuraminidase__InfluenzaA__AIW60708
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaaucggcauucuaacgacaccguucacgaucgcacgccguauagaacacugcugaugaaugaacucggcgugcccuuucaucuggggaccaagcaggucuguaucgccuggagcuccagcucuugccacgacggaaaagccuggcuucauguguguguuacaggccacgaugagaacgcuaccgcuuccuucauuuacaauggccggcugguggacagcaucgggucuugguccaagaaaauucuccgcacccaggaaagcgagugcgucuguaucaacggaacaugcacgguggugaugaccgauggcucugccuccgggaaggcggacacaaaaauucuguuuaucgaggaaggaaagaucguccacauuagcccucuuuccggcucugcccaacauguugaggaaugcagcuguuaucccagauacccuggggugcggugcgugugucgcgauaacuggaagggauccaauagacccaucgucgacauuaacgugaaagauuacagcaucguuucuuccuaugugugcagcggccuggucggcgacaccccgcggaagaaugacucuagcuccucuagccacugucucaacccuaauaacgaggaagggggacauggcgugaaagggugggcuuucgaugacggaaaugauguuuggaugggccgcacaauuuccgagaagcugagaagcggguacgagaccuuuaaagugaucgaaggauggucuaaccccaauuccaagcugcagaucaaccggcaggucauuguggaccgcggcaauagcucuggcuauuccgggaucuucagcgucgagggaaaauccugcauuaacagauguuuuuacguggaacucauccggggcagaaagcaggagacggaaguuugguggacaucuaauagcauugugguccugugcgggaccuccggaaccuauggcacagggucuuggccugauggcgccgacaucaaccuuaugcccauuuga

SEQ ID NO: 208849 - RNA, 1410 nt, Artificial Sequence
  derived and/or modified sequence opt5 from neuraminidase__InfluenzaA__AIW60710
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuacagucgauauuaacgugaaagacuacucuaucguuuccagcuaugugugcucuggccuggucggggacacccccagaaagaaugauagcuccucuagcucccauugucucgacccgaacaaugaggaaggaggccacggggugaaaggaugggcuuucgaugacggcaacgauguuuggauggggcggacgauuagcgagaagcugcgcucuggauacgagacauuuaaagugaucgaaggcugguccaagccuaauagcaaacugcagauuaacagacaggucaucguggaccggggcaaucgcucuggguauuccggaaucuucagcgucgaguccaagucuugcauuaacagauguuuuuacguggaacucauccggggcagaaagcaggagaccgaaguucuguggaccagcaauuccauuguggucuucugcgggacaucuggaaccuauggcacagggagcuggcccgauggcgccgacaucaaccuuaugccuauuuga

SEQ ID NO: 208850 - RNA, 1410 nt, Artificial Sequence; identical to SEQ ID NO: 197615
  derived and/or modified sequence opt5 from neuraminidase__InfluenzaA__AIW60711

SEQ ID NO: 208851 - RNA, 1410 nt, Artificial Sequence; identical to SEQ ID NO: 197615
  derived and/or modified sequence opt5 from neuraminidase__InfluenzaA__AIW60712

SEQ ID NO: 208852 - RNA, 1410 nt, Artificial Sequence
  derived and/or modified sequence opt5 from neuraminidase__InfluenzaA__AIW60713
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauugccagcucuuauguuuguagcggacuugugggcgauacccccagaaagaaugacuccucuagcuccagccauugccuggauccgaacaaugaggaaggcgggcacggagucaaaggcugggcuuucgacgaugggaacgacguguggaugggacggacgaucucugagaagcuccgcuccggcuacgagacauuuaaaguuaucgaaggguggagcaauccuaacucuaagcugcagauuaauagacaggugaucgucgaucggggaaaccgcuccggcuauagcggcauuuucuccguggaggggaaaucuuguaucaauagaugcuuuuacgucgaacugauucggggaagaaaggaggaaaccgaggugcucuggaccagcaacuccaucguuguguucuguggcacaucugggaccuauggaacaggcagcuggcccgacggggccgauauuaaucugaugccuaucuga

SEQ ID NO: 208853 - RNA, 1410 nt, Artificial Sequence
  derived and/or modified sequence opt5 from neuraminidase__InfluenzaA__AIW60714
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauugccagcucuuauguuuguagcggacuugugggcgauacccccagaaagaaugacuccucuagcuccagccauugccuggauccgaacaaugaggaaggcgggcacggagucaaaggcugggcuuucgacgaugggaacgacguguggaugggacggacgaucucugagaagcuccgcuccggcuacgagacauuuaaaguuaucgaaggguggagcaauccuaacucuaagcugcagauuaauagacaggugaucgucggacggggcaaccgcuccggcuauagcgggauuuucuccguggagggaaaaucuuguaucaauagaugcuuuuacgucgaacugauucggggcagaaaggaggaaaccgaggugcucuggaccagcaacuccaucguuguguucugugggacaucuggaaccuauggcacagggagcuggcccgauggcgccgacauuaaucugaugccuaucuga

SEQ ID NO: 208854 - RNA, 1410 nt, Artificial Sequence
  derived and/or modified sequence opt5 from neuraminidase__InfluenzaA__AIW60715
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaaaagauucugcgcacccaggagucugaaugugucugcaucaaugggacauguacgguggugaugaccgauggauccgcuagcggcaaagccgacacaaagauccucuuuauugaggaggggaagaucguccauaccuccacacugucuggaagcgcgcaacacguugaagagugcuccugcuauccuagauaccccggcgugcggugugugugccgcgauaacuggaaagggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgaaaaaucuagacucggcuaugagacauuuaagguuauugaggggugguccaacccuaaaagcaagcugcagaucaaucgccaggugauugucgaucggggaaacagaucuggcuacuccggcaucuucagcguggaagggaaguccuguauuaaucggugcuuuuaugucgagcugaucagaggacgcaaagaagagaccgaagugcucuggaccucuaacagcauuguuguguucuguggcacauccgggaccuacggaacaggcucuuggcccgacggggcugauaucaaucugaugccuaucuga

SEQ ID NO: 208855 - RNA, 1410 nt, Artificial Sequence; identical to SEQ ID NO: 199535
  derived and/or modified sequence opt5 from neuraminidase__InfluenzaA__AIW60716

SEQ ID NO: 208856 - RNA, 1410 nt, Artificial Sequence
  derived and/or modified sequence opt5 from neuraminidase__InfluenzaA__AIY54970
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagacggauagcuccucuagcucccauugccuggacccgaauaacgaggaaggcgggcacggagugaaaggcugggccuucgaugacgggaaugaucucuggaugggacggacaaucagccagaaccugcgcucuggcuacgagaccuuuaagguuaucgaggggugguccaauccuaacagcaaacugcagauuaauagacaggugaucgucgaccggggaaaccgcucuggcuauuccggcauuuucagcguggaagggaaguccuguaucaauagaugcuuuuacgucgagcucauucggggaagaaaacaagaaaccgaggugcuguggacaucuaacagcaucguuguguucuguggcaccuccgggacauauggaacgggcucuuggcccgauggggcugacauuaaucuuaugccuaucuga

SEQ ID NO: 208857 - RNA, 1410 nt, Artificial Sequence
  derived and/or modified sequence opt5 from neuraminidase__InfluenzaA__AIY54974
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugauguccgaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaaaagauccugcggacccaggaguccgaaugugugugcauuaacgggacauguacgguggucaugaccgauggaagcgcuuccggcaaagccgacacaaagauccucuuuaucgaggaggggaagauuguucacaccucuacacugagcggauccgcgcaacacguggaagagugcagcugcuauccucgcuaccccggcgugagaugugucugccgggauaauuggaaagggucuaaccgcccuaucguggacauuaacaucaaggacuacuccauuguuagcucuuauguguguagcggacuugucggcgauacccccagaaagaaugacuccucuagcuccagccauugccuggauccgaacaaugaagagggcgggcacggagugaaaggcugggccuucgacgaugggaacgacguuuggaugggacggacgaucucugaaaaacuccgcuccggcuacgagacauuuaaggugaucgagggguggagcaauccuaacucuaaacugcagauuaauagacaggucaagguggaucggggaaaccgcuccggcuauagcggcaucuucuccgucgaagggaagucuuguauuaauagaugcuuuuacguggagcugauccggggaagaaaagaagagaccaagguucucuggaccagcaacuccauuguggucuucuguggcacaucugggaccuauggaacaggcagcuggcccgacggggcugauaucaaucugaugccuauuuga

SEQ ID NO: 208858 - RNA, 1410 nt, Artificial Sequence
  derived and/or modified sequence opt5 from neuraminidase__InfluenzaA__AIY54982
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaaguuucgcucuggcuacgagacauucaaagugaucgaagggugguccaacccuaauagcaagcuccagauuaacagacaggucaucguggaucggggaaaucgcucuggcuauuccggcauuuuuagcgucgaggggaaauccuguaucaacagaugcuucuacguggaacugauucggggaagaaaggaggaaaccgagguucuguggaccucuaauagcaucguggucuucuguggcacauccgggaccuauggaacaggcucuuggcccgacggggcugauauuaaccucaugccuaucuga

SEQ ID NO: 208859 - RNA, 1410 nt, Artificial Sequence
  derived and/or modified sequence opt5 from neuraminidase__InfluenzaA__AIY54990
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugggauuaccggauucgccccuuuuagcaaagacaauuccauccgccugucugcgggcggggauaucugggugacaagagagcccuaugucagcugcgacccugauaaguguuaccaauucgcucuuggacagggcaccacacugaacaaugugcauuccaacgacaccguucacgaucggacgccguaucgcacacuccugaugaaugaacugggggugcccuuucaucucggaaccaagcaggucugcauugccuggucuagcuccagcugucacgacggcaaagccuggcugcaugugugcguuacaggcgaugacaagaacgcuaccgccucuuucaucuacaaugggagacuuguggauuccauugucagcuggucuaaagagauccugcggacccaggaauccgagugugugugcauuaacggaacauguacgguggucaugaccgacggcagcgcuuccgggaaggccgauacaaaaauccucuuuaucgaggaaggaaagauuguucacaccucuacacugagcggcuccgcgcaacacguggaggaaugcagcugcuauccucgcuaccccggggugagaugugucugccgggacaauuggaagggaucuaaccgcccuaucguggauauuaacaucaaagacuacuccauuguuagcagauauguguguucuggccuugucggcgacacgccccggaagaaugauagcuccucuagcucccauugccuggacccgaacaaugaggaagggggacacggcgugaaagggugggccuucgaugacggaaacgauguuuggaugggccgcaccaucagcgagaagucuagauccggguacgagacauuuaaagugaucgaaggauggagcaauccuaacucuaagcuccagauuaaucggcaggucaucguggaccgcggcaacagauccggcuauagcgggauuuucuccgucgagggaaaaucuuguaucaaucggugcuuuuacguggaacugauuagaggccgcaaggaggaaaccgagguucuguggaccagcaacuccaucguggucuucugugggacaucuggaaccuauggcacagggagcuggcccgauggcgcugacauuaaucucaugccuaucuga

SEQ ID NO: 208860 - RNA, 1401 nt, Artificial Sequence
  derived and/or modified sequence opt5 from neuraminidase__InfluenzaA__AJD78177
augaaccccaaucagaagaucauugccaucggcagcgugucccugauuaucgcugucauuugccuccugaugcaaaucgccauccuuaccacaacgaugacccugcacuucaugcagaacgaguguucuaauccuagcaacaaucagguuaugccgugcgaacccauuaucauugagagaaacacagugcaucucaauaacaccacaaucgaacgggagauuuguccuaaagcggcugaauacaagaauugguccaaaccccagugccaaaucaccggguuugccccuuucucuaaggacaacagcauucgccuguccgccggaggcgauaucugggugacaagagagcccuaugucucuuguagccuugacaaaugcuaccaguuugcucuggggcagggaaccacgcucaagaauaagcacuccaacggcaccacacaugaucggaccccucaccgcacacugcugaugaaugagcucggggugccguuccaucugggaaccaaacagguuuguaucgccuggucuagcuccagcugcuaugacggcaaggcuuggcuucacauuugugugacgggcgaugacaaaaacgccacagcgucuaucauuuacgaugggaugcuggucgacuccaucggaagcuggucuaagaauauucucagaacccaagaauccgagugcguguguaucaacggcacaugcgccguugugaugaccgaugggagcgcuuccggaaaagccgacacccggguccuguuuauccgcgaaggcaagauuaucaacauuucuccccuuagcggguccgcucagcacguggaggagugcagcuguuauccuagauaccccgaagugcggugcgucugucgcgauaauuggaagggaucuaacagaccuauccuguauauuaauauggccgacuacuccaucgagagcucuuacguuugcagcggccucgugggcgauacaccccggaacgacgacuccucuagcuccagcaauugucgcgauccgaacaaugaaagaggggcgccuggagugaaaggcugggccuucgacgaugggaacgacgucuggaugggacggacgaucaagaauggcucucgcuccggguaugagaccuuuagagugguuaacggauggacaauggcuaauagcaaaucucagauuaacagacaggugaucgucgauuccgacgauuggagcggcuacuccggcauuuucucuguggaagggaagaaaugcaucaaucgguguuuuuauguugagcugauucgcggacggccccaagagccuagagugugguggaccagcaacuccaucauugucuucugcggcacaucugggaccuacggaacgggcagcuggcccgacggggccaauaucaacuuuaugcccaucuga

SEQ ID NO: 208861 - RNA, 1401 nt, Artificial Sequence
  derived and/or modified sequence opt5 from neuraminidase__InfluenzaA__AJD78189
augaaccccaaucagaagaucauugccaucggcagcgugucccugauuaucgcuauuaucugccuccugaugcaaaucgccauucuuaccacaacgaugacccugcacuucagacagaacgaguguaauaacucuagcaauaaccaggucaugccuugcgaaccgaucauuaucgagcggaauacaguucaucucaacuccaccacaauugaacgcgagaucugucccaaaguggcggaauacaagaauuggucuaaaccucagugccaaauuaccggguuugcucccuucagcaaggacaacuccaucagacugucugccggaggcgauaucugggugacacgggagccuuaugucagcuguucccuugacaaaugcuaccaguuugcccuggggcagggaaccacgcucaagaauaagcacagcaacggcaccacacaugaucgcaccucucacagaacacugcugaugaaugagcucggggugcccuuccaucugggaaccaaacagguuuguauugcuugguccagcagcuccugcuaugacggcaaggccuggcuucacaucugugugacgggcgaugacaaaaacgcuacagccagcauuaucuacaaugggaugcuggucgauucuauuggauccuggagcaagaacauccuccggacccaagaauccgagugcguguguaucaacggcacaugcgcgguugugaugaccgacgggucugccagcggaaaagcugauacccgcguccuguuuauuagagaaggcaagaucauuaauaucuccccucuuagcgggucugcccagcacguggaggagugcuccuguuauccgcgguaccccgaagugcgcugcgucuguagagacaacuggaagggaagcaaucggccuauucuguauaucaacauggcugauuacucuaucgagagcuccuacguuugcucuggccucgugggcgacacaccccgcaaugaugacagcuccucuucuuccaacuguaaagacccuaauagcgaaagaggggcccccggagugaagggcugggcguucgaugacgggaacgaugucuggaugggacggacgauuaaaaauggcucucgcuccggguaugagaccuuuagagugcugaacggauggacaguugccaauagcaagucccagaucaacagacaggugauugucgacucugaugacuggagcggcuacuccggcaucuucucuguggaagggaaaaagugcauuaaucgguguuuuuauguugagcugauccgcggacggccgcaagagccuagagugugguggaccagcaacuccauuaucgucuucugcggcacaagcgggaccuacggaacgggcucuuggcccgauggggcuaauaucaacuuuaugccuauuuga

SEQ ID NO: 208862 - RNA, 1401 nt, Artificial Sequence
  derived and/or modified sequence opt5 from neuraminidase__InfluenzaA__AJD78201
augaaccccaaucagaagaucaccgccauuggcagcgugucccugaucauugcuaucauuugccuccugaugcaaaucgccauccuuacaacgaccaugacacugcacuucagacagaaagaguguucuaacccuagcaauaaccaggucaugccgugcgaacccauuaucauugagcggaauaccguucaucucaacuccacaaccaucgaacgcgagauuuguccuaagguggcggaauacaaaaauuggucuaagccccagugccugaucacaggguuugcuccuuucagcaaagacaacuccauuagacuuucugccggaggcgauaucugggugacccgggagcccuaugucagcuguuccccugacaagugcuaccaauuugcccuggggcagggaacgacccucaagaauaaacacagcaacggcacaacccaugaucgcacaccgcacagaacccugcugaugaaugagcucggggugcccuuccaucugggaacgaagcagguuuguaucgcuuggucuuccagcucuugcuaugacggcaaagccuggcuucacauuugugugacaggcgaugacaagaacgcuaccgccuccaucauuuacgaugggaugcuggucgacagcaucggaucuugguccaaaaauauucuccggacacaggaaagcgagugcguguguaucaacgggaccugcgcgguugugaugaccgauggcuccgccucuggagucgcugacacacgcgugcuguuuaucagagaaggcaagauuaucaauauucggccucuuagcggguccgcccaacacguggaggagugcagcuguuauccccgcuacccugaagucagaugcguuugucgggauaacuggaagggaucuaaccgccccaucauuuauaucaauauggcugacuacuccaucgagagcucuuacgugugcagcggccuggugggcgauacgccgagaaacgacgacuccucuagcuccagcaauugucgggauccuaacaaugaacgcggggcccccggagucaaaggcugggcguucgacgaugggaacgacguguggaugggaagaaccauuaagaauggcucucgguccggguaugagacauuuagaguuaucaacggauggaccauggccaauagcaaaucucagauuaaccgccaggugaucgucgauuccgacgauuggagcggcuacuccggcauuuucucuguggaagggaagaaaugcaucaaucgguguuuuuauguugagcucauuagaggacgcccucaggagccccgggugugguggacaagcaacuccaucaucgucuucugcggcaccucugggacguacggaacaggcagcuggcccgacggggcuaauauuaacuuuaugccuaucuga

SEQ ID NO: 208863 - RNA, 1401 nt, Artificial Sequence
  derived and/or modified sequence opt5 from neuraminidase__InfluenzaA__AJD78213
augaaccccaaucagaagaucaccgccauuggcagcgugucccugaucauugcuaucauuugccucuucaugcaaaucgccauccugacaacgaccaugacacuucacuuuagacagaaagaguguucuaacccuagcaauaaccaggucaugccgugcgaacccauuaucauugagcggaauaccguucaucugaacuccacaaccaucgaacgcgagauuuguccuaagguggcggaauacaaaaauuggucuaagccccagugccucaucacaggguucgcuccuuuuagcaaagacaacuccauuagacugucugccggaggcgauaucugggugacccgggagcccuaugucagcuguuccccugacaagugcuaccaauucgcccuugggcagggaacgacccugaagaauaaacacagcaacggcacaacccaugaucgcacaccgcacagaacccuccugaugaaugagcugggggugcccuuucaucucggaacgaagcagguuuguaucgcuuggucuuccagcucuugcuaugacggcaaagccuggcugcacauuugugugacaggcgaugacaagaacgcuaccgccuccaucauuuacgaugggaugcuugucgacagcaucggaucuugguccaaaaauauucugcggacacaggaaagcgagugcguguguaucaacgggaccugcgcgguugugaugaccgauggcuccgccucuggagucgcugacacacgcgugcucuuuaucagagaaggcaagauuaucaauauucggccucugagcggguccgcccaacacguggaggagugcagcuguuauccccgcuacccugaagucagaugcguuugucgggauaacuggaagggaucuaaccgccccaucauuuauaucaauauggcugacuacuccaucgagagcucuuacgugugcagcggccuugugggcgauacgccgagaaacgacgacuccucuagcuccagcaauugucgggauccuaacaaugaacgcggggcccccggagucaaaggcugggcguuugacgaugggaacgacguguggaugggaagaaccauuaagaauggcucucgguccggguaugagacauucagaguuaucaacggauggaccauggccaauagcaaaucucagauuaaccgccaggugaucgucgauuccgacgauuggagcggcuacuccggcauuuucucuguggaagggaagaaaugcaucaaucgguguuucuauguugagcugauuagaggacgcccucaggagccccgggugugguggacaagcaacuccaucaucgucuuuugcggcaccucugggacguacggaacaggcagcuggcccgacggggcuaauauuaacuucaugccuaucuga

SEQ ID NO: 208864 - RNA, 1410 nt, Artificial Sequence; identical to SEQ ID NO: 205946
  derived and/or modified sequence opt5 from neuraminidase__InfluenzaA__AJI80140

SEQ ID NO: 208865 - RNA, 1410 nt, Artificial Sequence; identical to SEQ ID NO: 205946
  derived and/or modified sequence opt5 from neuraminidase__InfluenzaA__AJI80152

SEQ ID NO: 208866 - RNA, 1410 nt, Artificial Sequence; identical to SEQ ID NO: 208722
  derived and/or modified sequence opt5 from neuraminidase__InfluenzaA__AJI80164

SEQ ID NO: 208867 - RNA, 1410 nt, Artificial Sequence; identical to SEQ ID NO: 208661
  derived and/or modified sequence opt5 from neuraminidase__InfluenzaA__AJI80175

SEQ ID NO: 208868 - RNA, 1410 nt, Artificial Sequence; identical to SEQ ID NO: 208661
  derived and/or modified sequence opt5 from neuraminidase__InfluenzaA__AJI80187

SEQ ID NO: 208869 - RNA, 1410 nt, Artificial Sequence; identical to SEQ ID NO: 208661
  derived and/or modified sequence opt5 from neuraminidase__InfluenzaA__AJI80199

SEQ ID NO: 208870 - RNA, 1410 nt, Artificial Sequence; identical to SEQ ID NO: 208661
  derived and/or modified sequence opt5 from neuraminidase__InfluenzaA__AJI80211

SEQ ID NO: 208871 - RNA, 1410 nt, Artificial Sequence; identical to SEQ ID NO: 206895
  derived and/or modified sequence opt5 from neuraminidase__InfluenzaA__AJI80223

SEQ ID NO: 208872 - RNA, 1410 nt, Artificial Sequence; identical to SEQ ID NO: 208661
  derived and/or modified sequence opt5 from neuraminidase__InfluenzaA__AJI80235

SEQ ID NO: 208873 - RNA, 1410 nt, Artificial Sequence; identical to SEQ ID NO: 206895
  derived and/or modified sequence opt5 from neuraminidase__InfluenzaA__AJI80247

SEQ ID NO: 208874 - RNA, 1410 nt, Artificial Sequence; identical to SEQ ID NO: 208680
  derived and/or modified sequence opt5 from neuraminidase__InfluenzaA__AJI80259

SEQ ID NO: 208875 - RNA, 1410 nt, Artificial Sequence; identical to SEQ ID NO: 205170
  derived and/or modified sequence opt5 from neuraminidase__InfluenzaA__AJI80271

SEQ ID NO: 208876 - RNA, 1410 nt, Artificial Sequence; identical to SEQ ID NO: 208661
  derived and/or modified sequence opt5 from neuraminidase__InfluenzaA__AJI80283

SEQ ID NO: 208877 - RNA, 1410 nt, Artificial Sequence
  derived and/or modified sequence opt5 from neuraminidase__InfluenzaA__AJI80306
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucuggaccggacgcccuaucgcacacuccugaugaaugaacugggggugccuuuucaccucggaaccaagcaggucugcauugccugguccucuagcuccugucaugauggcaaagccuggcugcacgugugcaucacaggcgacgauaagaacgcuaccgccagcuucauuuacaaugggagacuuguugacucuguggucuccuggagcaaagagauccugcggacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccccgcuacccuggggugagaugugucugccgggauaacuggaagggaagcaaucgccccaucguggacauuaacaucaaagaucacucuauuguuuccagcuacguguguucuggccuugucggcgacaccccgagaaagaaugacagcuccucuagcucccauugccuggauccuaacaaugaggaagggggacacggcgugaaagggugggccuucgacgauggaaacgacguuuggaugggccggacgaucaaugagacaagccgccucggguaugagaccuuuaaggugaucgaaggauggucuaaccccaaauccaagcugcagauuaauaaacaggucaucguggauagaggcgaccggagcggcuacucugggauuuucuccgucgagggaaagagcuguaucaaccgcugcuuuuauguggaacugauuagaggccggaaggaggaaaccgagguucucuggacauccaauucuaucguggucuucugugggaccagcggaacauacggcacgggguccuggccugauggcgcugaccugaaccuuaugcccauuuga

SEQ ID NO: 208878 - RNA, 1410 nt, Artificial Sequence
  derived and/or modified sequence opt5 from neuraminidase__InfluenzaA__AJI80318
augaaccccaaucagaagaucauuaccaucggcagcgugugcaugacaauugggauggccaaccugauccuccaaauuggaaauaucaucuccauuuggaucucucacagcauucagcugggcaaccagucccagaucgaggcuuguaaucaaaacgucauuacguacgaaaauaacaccuggguuaaucagacauaugugaacaucucuaauaccaacuucgccacagggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauagcggagcugucgccgugcugaaguauaacggcaucauuacagacaccaucaagucuuggaaaaauaacauucucagaacacaagaguccgagugugcgugcgugaaugggagcuguuucaccaucaugacggauggaccgucugacggccaggccagcuacaagauuuuucggaucgaaaaaggcaagaucgucaaauccguugagaugaacgcucccaauuaucauuacgaagagugcucuuguuacccugauagcuccgagauuacaugcgugugccgcgacaacuggcacgggagcaauagacccugggugucuuucaaccagaaucuggaauaucagaucggauacauuuguuccggcgucuuuggggauaacccucggcccaaugacaagaccggaagcugcggcccggugucuuccaacggggccaauggaguuaagggcuucagcuuuaaauauggcaacgggguguggaucggacgcacaaaguccauuucuagcagaaaaggcuucgagaugaucugggauccuaacggguggaccggaaccgacaauaacuuuuccauuaagcaagacaucgucggcaucaaugaauggucuggguacagcggcuccuucgugcagcaucccgagcuuacaggacuggauuguauucggccuugcuucuggguugaacucauccgcggcagacccaaagagaacacgauuuggaccagcgggucuuccaucagcuuuuguggagucaauucugacacagugggcugguccuggcccgauggggcugagcugccuuucaccauugacaaguga

SEQ ID NO: 208879 - RNA, 1410 nt, Artificial Sequence
  derived and/or modified sequence opt5 from neuraminidase__InfluenzaA__AJI80329
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggaaaaacaauauucucagaacacaagagagcgagugugcgugcgugaacgggucuuguuucaccaucaugacggauggaccgagcgacggccaggccuccuacaagauuuuucggaucgaaaaaggcaagaucgucaaaucuguugagaugaaugcucccaacuaucauuacgaagagugcagcuguuacccugauuccagcgagauuacaugcgugugccgcgacaauuggcacgggucuaacagacccuggguguccuucaaucagaaccuggaauaucagaucggauacauuuguagcggcgucuuuggggauaauccucggcccaacgacaagaccggaucuugcggcccgguguccagcaauggggccaacggaguuaagggcuucuccuuuaaauauggcaaugggguguggaucggacgcacaaagucuauuagcuccagaaaaggcuucgagaugaucugggauccuaacggguggaccggaaccgacaacaauuuuucuauuaagcaagacaucgucggcaucaacgaauggagcggguacuccggcagcuucgugcagcaucccgagcuuacaggacuggauuguauucggccuugcuucuggguugaacucauccgcggcagacccaaagagaauacgauuuggaccucuggguccagcaucucuuuuuguggagugaacuccgacacagucggcuggagcuggcccgauggggcugagcugccuuucaccauugacaaguga

SEQ ID NO: 208880 - RNA, 1410 nt, Artificial Sequence
  derived and/or modified sequence opt5 from neuraminidase__InfluenzaA__AJI80340
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauucuggagcuguggccguccugaaguauaauggcauuaucacagacaccauuaaguccuggaaaaacaauauccucagaacacaagagagcgagugugcgugcgugaacgggucuuguuucaccauuaugacggauggaccgagcgacggccaggccuccuacaagaucuuucggaucgaaaaaggcaagauugugaaaucugucgagaugaaugcucccaacuauuacuacgaagagugcagcuguuauccugauuccagcgagaucacaugcguuugccgcgacaauuggcaugggucuaacagacccuggguguccuucaaucagaaccuggaauaccagauuggauauaucuguagcggcauuuuuggggauaauccucggcccaacgacaagaccggaucuugcggcccgguguccagcaauggggccaacggagucaagggcuucuccuuuaaauacggcaaugggguguggaucggacgcacaaagucuauuagcuccagaaaaggcuucgagaugaucugggauccuaacggguggaccggaaccgacaacaauuuuucuaucaagcaagacauuguuggcaucaacgaauggagcggguauuccggcagcuucgugcagcaccccgagcuuacaggacuggauuguauucggccuugcuucugggucgaacucauccgcggcagacccaaagagaauacgauuuggaccucuggguccagcaucucuuuuuguggagugaacuccgacacaguuggcuggagcuggcccgauggggcugagcugccuuucaccaucgacaaguga

SEQ ID NO: 208881 - RNA, 1410 nt, Artificial Sequence; identical to SEQ ID NO: 205170
  derived and/or modified sequence opt5 from neuraminidase__InfluenzaA__AJI80351

SEQ ID NO: 208882 - RNA, 1410 nt, Artificial Sequence
  derived and/or modified sequence opt5 from neuraminidase__InfluenzaA__AJI80363
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccaaaccugcugaguaccggaauugguccaagccccagugugggauuaccggauucgccccuuuuucuaaagacaacagcauccgccuguccgcgggcggggauaucugggugacaagagagcccuaugucucuugcgacccugauaaguguuaccaauucgcucuuggacagggcaccacacugaauaacgugcauagcaauaacaccgcccgggaccgcacgccguauagaacacuccugaugaaugaacuggggguucccuuucaccucggaaccaaacaggugugcauugccugguccucuagcuccugucaugauggcaaggcuuggcugcacgucugcaucacaggcgacgauaagaacgccaccgcuagcuucauuuacaaugggcggcuuguggacucuguuguguccuggagcaaagagauccugcgcacccaggaaucugagugugucugcauuaacggaacauguacgguggugaugaccgauggcuccgccagcgggaaggcggacacaaaaauccucuuuaucgaggaaggaaagauuguccauaccuccacacugucuggcggggcccaacacguugaggaaugcagcugcuauccuagauaccccggagugcggugugugugccgcgauaacuggaagggcuccaauagaccuaucgucgacauuaacaucaaagaucacagcauugugucuuccuacguuuguagcggccuugugggggacacgccccggaagaaugacucuagcuccucuagccauugccugaacccgaauaacgaggaaggaggccacggggucaaaggaugggcuuucgaugacggcaaugauguguggauggggcgcaccaucaacgagacauccagacucggauaugagaccuuuaagguuaucgaaggcuggagcaauccuaaaucuaagcugcagauuaaccgccaggugaucgucgaccggggcgauagauccggguacagcggaauuuucucuguggagggcaaauccuguaucaaucggugcuuuuaugucgaacugauuagagggcgcaaggaggaaaccgaggugcucuggacaagcaacuccaucguuguguucuguggaaccucuggcacauacgggacgggcagcuggcccgacggagccgaucugaaucuuaugccuauuuga

SEQ ID NO: 208883 - RNA, 1410 nt, Artificial Sequence
  derived and/or modified sequence opt5 from neuraminidase__InfluenzaA__AJI80375
augaaccccaaucagaagaucauuaccaucggcagcgugucccugacaauuucuacgaucugccucuucaugcaaauugccauccugaucaccacagucacccuucacuuuaaacagcaugaguucaacagcccuccgaauaaccagguuaugcugugugaacccacaauuaucgagagaaauauuaccgaaaucguguaccucacaaacaccacgauugagaaggaaaucugcccuaaacccgcugaguaucggaauugguccaagccucagugugggauuaccggauuugcccccuucucuaaagacaacagcauccgccuguccgcgggcggggauaucugggugacaagagagccuuacgucucuugcgacccggauaaguguuaucaauuugcucuuggacagggcaccacacugaauaacgugcacagcaauaacaccguucgggaccgcacgcccuacagaacacuccugaugaaugaacugggggugccuuuccaucucggaaccaagcaggucugcauugccugguccuccucuuccugucacgauggcaaagccuggcugcaugugugcaucacaggcgacgauaagaacgcuaccgccagcuuuauuuauaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuucaucgaggaaggaaagauuguucacaccuccacacugucuggcagcgcgcaacacguggaggaaugcuccugcuaccccagauauccuggggugcggugugucugccgcgauaacuggaagggaagcaauagacccaucguggacauuaacaucaaagaucauucuauuguuuccagcuacguguguucuggccuugucggcgacaccccgcggaagaaugacagcuccucuagcucccacugccuggauccuaacaaugaggaagggggacauggcgugaaagggugggccuuugacgauggaaacgacguuuggaugggccgcacgaucaaugagacaagcagacucggguacgagaccuucaaggugaucgaaggauggucuaaccccaaauccaagcugcagauuaaucggcaggucaucguggaucgcggcgacagaagcggcuauucugggauuuuuagcgucgagggaaaaagcuguaucaaccggugcuucuacguggaacugauuagaggccgcaaggaggaaaccgagguucucuggacauccaauucuaucguggucuuuugugggaccagcggaacauauggcacgggguccuggccugauggcgcugaccugaaccuuaugcccauuuga

SEQ ID NO: 208884 - RNA, 1410 nt, Artificial Sequence; identical to SEQ ID NO: 208700
  derived and/or modified sequence opt5 from neuraminidase__InfluenzaA__AJI80387

SEQ ID NO: 208885 - RNA, 1410 nt, Artificial Sequence; identical to SEQ ID NO: 208700
  derived and/or modified sequence opt5 from neuraminidase__InfluenzaA__AJI80398

SEQ ID NO: 208886 - RNA, 1410 nt, Artificial Sequence; identical to SEQ ID NO: 208700
  derived and/or modified sequence opt5 from neuraminidase__InfluenzaA__AJI80409

SEQ ID NO: 208887 - RNA, 1410 nt, Artificial Sequence; identical to SEQ ID NO: 208700
  derived and/or modified sequence opt5 from neuraminidase__InfluenzaA__AJI80420

SEQ ID NO: 208888 - RNA, 1410 nt, Artificial Sequence; identical to SEQ ID NO: 208700
  derived and/or modified sequence opt5 from neuraminidase__InfluenzaA__AJI80431

SEQ ID NO: 208889 - RNA, 1410 nt, Artificial Sequence; identical to SEQ ID NO: 208695
  derived and/or modified sequence opt5 from neuraminidase__InfluenzaA__AJI80442

SEQ ID NO: 208890 - RNA, 1410 nt, Artificial Sequence; identical to SEQ ID NO: 208700
  derived and/or modified sequence opt5 from neuraminidase__InfluenzaA__AJI80454

SEQ ID NO: 208891 - RNA, 1410 nt, Artificial Sequence; identical to SEQ ID NO: 208695
  derived and/or modified sequence opt5 from neuraminidase__InfluenzaA__AJI80465

SEQ ID NO: 208892 - RNA, 1410 nt, Artificial Sequence; identical to SEQ ID NO: 208700
  derived and/or modified sequence opt5 from neuraminidase__InfluenzaA__AJI80477

SEQ ID NO: 208893 - RNA, 1410 nt, Artificial Sequence; identical to SEQ ID NO: 208700
  derived and/or modified sequence opt5 from neuraminidase__InfluenzaA__AJI80488

SEQ ID NO: 208894 - RNA, 1410 nt, Artificial Sequence; identical to SEQ ID NO: 208722
  derived and/or modified sequence opt5 from neuraminidase__InfluenzaA__AJI80499

SEQ ID NO: 208895 - RNA, 1410 nt, Artificial Sequence; identical to SEQ ID NO: 208700
  derived and/or modified sequence opt5 from neuraminidase__InfluenzaA__AJI80510

SEQ ID NO: 208896 - RNA, 1410 nt, Artificial Sequence; identical to SEQ ID NO: 208722
  derived and/or modified sequence opt5 from neuraminidase__InfluenzaA__AJI80521

SEQ ID NO: 208897 - RNA, 1410 nt, Artificial Sequence
  derived and/or modified sequence opt5 from neuraminidase__InfluenzaA__AJJ98767
augaaccccaaucagaagaucauuaccaucggcagcgugucccugacaauuucuacgaucugcuucuuuaugcaaauugccauccucaucaccacagucacccugcacuucaaacaguacgaguuuaacagcccuuccaauaaccagguuaugcuuugugaaccgacaauuaucgagagaaauauuaccgaaaucguguaucugacaaacaccacgauugagaaggaaaaaugccccaagccugcugaguaccggaauuggucuaaaccccagugugacaucaccggguucgccccuuuuagcaaggauaacuccauucgccucucugcgggaggcgacaucugggugacaagagagcccuaugucagcugcgauccugacaaguguuaccaauucgcucuggggcagggaaccacacuuaauaacgugcauuccaauaacaccguucgggaucgcacgccguauagaacacugcucaugaaugaacugggcgugcccuuucaccuggggaccaaacaggucugcaucgccuggucuagcuccagcugucaugacggaaaggccuggcuccacgugugcauuacaggcgaugacaaaaacgcuaccgccucuuucaucuacaauggccggcugguugauuccguggucagcuggucuaaggagauucuucgcacccaggaauccgagugugugugcaucaacgggacauguacgguggucaugaccgacggaagcgcuuccggcaaagccgauacaaagauucuguuuaucgaggaagggaagaucguucauaccucuacacucagcggauccgcgcaacacguggaggaaugcagcugcuauccuagauaccccggcgugcggugugucugccgcgacaacuggaaagggucuaauagaccuauuguggauaucaacauuaaggaccacuccaucguuagcucuuacguguguagcggacuggucggcgacacgccccggaaaaaugauuccucuagcuccagccauugccuugacccgaacaaugaggaaggcgggcacggagugaagggcugggccuucgaugacggggaugacguuuggaugggacgcaccauuucugagaaauccagacugggcuaugagacauuuaaggugaucgaaggguggagcaacccuaaaucuaagcuccagaucaaucggcaggucauuguggaucgcggaaacagauccggcuacagcggcaucuucuccgucgaggggaagucuuguauuaaucggugcuuuuauguggaacugaucagaggacgcaaagaggaaaccgacguucuguggaccagcaacuccauuguggucuucuguggcacaucugggaccuacggaacaggcagcuggcccgauggggcugacaucaaucucaugccuauuuga

SEQ ID NO: 208898 - RNA, 1410 nt, Artificial Sequence
  derived and/or modified sequence opt5 from neuraminidase__InfluenzaA__AJJ98779
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacccgcugaguaccggaauugguccaagccucagugugacaucacaggguucgcccccuuuucuaaagauaacagcauucgccucuccgcgggaggcgacaucugggugaccagagagccuuaugucucuugcgauccggacaaguguuaccaauucgcucuggggcagggaacaacccuuaauaacgugcauagcaaugauacgguucgggaccgcacacccuauagaacccugcucaugaacgaacugggcgugccuuuucaccuggggacaaagcaggucugcaucgccugguccagcagcuccugucaugauggaaaagccuggcuccacgugugcauuaccggcgacgauaagaaugcuaccgccagcuucaucuacaacggccggcugguugacucuauuguguccuggacaaaagagauccuucgcacgcaggaaagcgagugugucugcauuaaugggaccuguacaguggugaugaccgauggaucugcuuccggcaaggccgacacaaaaauccuguuuaucgaggaagggaagauuguccauaccagcacgcucuccggaucugcgcaacacguugaggaaugcagcugcuaucccagauacccuggcgugcggugugugugccgcgauaacuggaagggguccaacagacccaucgucgacauuaauaucaaagaccacagcauugugucuuccuacguuuguagcggacuggugggcgauacaccgcggaagaacgacucuagcuccucuagccauugccuugauccuaauaacgaggaaggcgggcacggagucaaaggcugggccuucgacgaugggaaugacguguggaugggacgcaccaucuccgagaagucuagacugggcuaugagaccuuuaaaguuaucgaaggguggucuaaccccaaguccaaacuccagauuaaucgccaggugaucgucgaucggggaaacagaagcggcuacucuggcauuuucuccguggagggaaagagcuguaucaaucggugcuuuuaugucgaacugauuagagggcgcaaggaggaaacagaggugcuguggaccuccaacucuaucguuguguucuguggcacaagcgggacguacggaaccggcuccuggccugacggggcugauauuaaucucaugcccaucuga

SEQ ID NO: 208899 - RNA, 1410 nt, Artificial Sequence; identical to SEQ ID NO: 205170
  derived and/or modified sequence opt5 from neuraminidase__InfluenzaA__AJJ98791

SEQ ID NO: 208900 - RNA, 1410 nt, Artificial Sequence
  derived and/or modified sequence opt5 from neuraminidase__InfluenzaA__AJJ98803
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaagguucgggaccgcacccccuauagaacgcugcucaugaaugaacugggggugccuuuucaccugggaacaaaacaggucugcauugccugguccucuagcuccugucaugauggcaaggccuggcuccacgugugcaucaccggcgacgauaaaaacgcuacagccagcuucauuuacaaugggcggcugguugacucuguggucuccuggagcaaggagauccuucgcacccaggaaucugagugugugugcauuaacggaaccuguacaguggucaugacggauggcuccgcuagcgggaaagccgacaccaagauccuguuuaucgaggaaggaaagauuguucauacauccacccucucuggcagcgcgcaacacguggaggaaugcuccugcuaucccagauacccuggggugcggugugucugccgcgauaacuggaaaggaagcaauagacccaucguggacauuaacaucaaggaucacucuauuguuuccagcuacguguguucuggccuggucggcgacacaccgcggaaaaaugacagcuccucuagcucccauugccuugauccuaacaaugaggaagggggacacggcgugaaggggugggccuucgacgauggaaacgacguuuggaugggccgcaccaucaaugagacgagcagacugggguaugagacauuuaaagugaucgaaggauggucuaaccccaaguccaaacuccagauuaaucggcaggucaucguggaucgcggcgacagaagcggcuacucugggauuuucuccgucgagggaaagagcuguaucaaccggugcuuuuauguggaacugauuagaggccgcaaggaggaaaccgagguucuguggaccuccaauucuaucguggucuucugugggacaagcggaaccuacggcacaggguccuggccugauggcgcugaccucaaccugaugcccauuuga

SEQ ID NO: 208901 - RNA, 1410 nt, Artificial Sequence; identical to SEQ ID NO: 205170
  derived and/or modified sequence opt5 from neuraminidase__InfluenzaA__AJJ98815

SEQ ID NO: 208902 - RNA, 1410 nt, Artificial Sequence
  derived and/or modified sequence opt5 from neuraminidase__InfluenzaA__AJJ98827
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacaauauuguuucuuccuacguguguagcggccuggucggcgacaccccgcggaagaacgacucuagcuccucuagccauugccuugauccuaauaacgaggaagggggacacggcgugaaagggugggccuucgacgauggaaaugacguuuggaugggccgcacgaucaacgagacauccagacugggguaugagaccuuuaaggugaucgaaggauggagcaaucccaaaucuaagcuccagauuaaccggcaggucaucguggaucgcggcgacagauccggcuacagcgggauuuucucugucgagggaaaauccuguaucaaucggugcuuuuauguggaacugauuagaggccgcaaggaggaaaccgagguucuguggacaagcaacuccaucguggucuucugugggaccucuggaacauacggcacggggagcuggccugauggcgcugaccucaaucugaugcccauuuga

SEQ ID NO: 208903 - RNA, 1410 nt, Artificial Sequence; identical to SEQ ID NO: 204167
  derived and/or modified sequence opt5 from neuraminidase__InfluenzaA__AJJ98839

SEQ ID NO: 208904 - RNA, 1410 nt, Artificial Sequence; identical to SEQ ID NO: 202542
  derived and/or modified sequence opt5 from neuraminidase__InfluenzaA__AJJ98851

SEQ ID NO: 208905 - RNA, 1410 nt, Artificial Sequence
  derived and/or modified sequence opt5 from neuraminidase__InfluenzaA__AJJ98863
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaacgcacgcccuauagaacacugcucaugaaugagcugggcgugccuuuucaccuggggaccaagcaggucugcauugccugguccucuagcuccugucaugauggaaaagccuggcuccacgugugcaucacaggcgacgauaagaacgcuaccgccagcuucauuuacaauggccggcugguugacucuguggucuccuggagcaaagaaauccuucgcacccaggagucugaguguauuugcaucaacgggacauguacgguggugaugaccgauggauccgcuagcggcaaggccgacacaaaaauccuguuuauugaagaggggaagaucguccauaccuccacacucucuggaagcgcgcaacacguugaagagugcuccugcuaucccagauacccuggcgugcggugugugugccgcgauaacuggaaggggagcaauagacccauugucgacaucaacaugaaagaucacucuauuguguccagcuacguuuguucuggacuggugggcgacaccccgcggaagaaugacagcuccucuagcucccauugccuugauccuaacaaugaagagggcgggcacggagucaaaggcugggccuucgacgaugggaacgacguguggaugggacgcacgaucagcgagaagucuagacugggcuaugaaacauuuaaaguuaucgaggggugguccaaucccaagagcaaacuccagauuaaccgccaggugaucgucgaucggggaaauagaucuggcuacuccggcauuuucagcguggaagggaaguccuguaucaaccggugcuuuuaugucgagcugauuagaggacgcaaggaagagaccgaggugcuguggaccucuaauagcaucguuguguucuguggcacauccgggaccuacggaacaggcucuuggccugacggggcugauauuaaccucaugcccaucuga

SEQ ID NO: 208906 - RNA, 1410 nt, Artificial Sequence
  derived and/or modified sequence opt5 from neuraminidase__InfluenzaA__AJJ98875
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaaugauaccguucggaaccgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucagcgagaagucuagacugggcuaugagacauuuaaagugaucgaagggugguccaaucccaagagcaaacuccagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucuguggaccucuaauagcaucguggucuucuguggcacauccgggaccuacggaacaggcucuuggccugauggggcugacauuaaccucaugcccaucuga

SEQ ID NO: 208907 - RNA, 1410 nt, Artificial Sequence
  derived and/or modified sequence opt5 from neuraminidase__InfluenzaA__AJJ98887
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggaaucgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaacgggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaauuggaaggggagcaacagaccuauugucgacaucaauauuaaagaucacucuaucguguccagcuacguuuguucuggacuugugggcgacacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgacgugcucuggaccucuaacagcauuguuguguucuguggcacauccgggaccuacggaacaggcucuuggcccgauggggcugacaucaaucugaugccuaucuga

SEQ ID NO: 208908 - RNA, 1410 nt, Artificial Sequence
  derived and/or modified sequence opt5 from neuraminidase__InfluenzaA__AJJ98899
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucggaaucgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagagauccugcgcacacaggaaucugagugugucugcauuaacgggacguguaccguggugaugacagauggauccgcuagcggcaaggccgacaccaaaauccucuuuaucgaggaagggaagauuguccauacauccacccugucuggaagcgcgcaacacguugaggaaugcuccugcuauccuagauaccccggcgugcggugugugugccgcgauaauuggaaggggagcaacagaccuaucgucgacauuaauaucaaagaucacucuauuguguccagcuacguuuguucuggacuugugggcgacacgccccggaagaacgacagcuccucuagcucccauugccuggauccgaauaacgaggaaggcgggcacggagucaaaggcugggccuucgacgaugggaaugacguguggaugggacgcacaaucagcgagaagucuagacucggcuaugagaccuuuaaaguuaucgaagggugguccaacccuaagagcaaacugcagauuaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggacaucuaacagcaucguuguguucuguggcaccuccgggacauacggaacgggcucuuggcccgacggggcugauauuaaucugaugccuaucuga

SEQ ID NO: 208909 - RNA, 1410 nt, Artificial Sequence; identical to SEQ ID NO: 205170
  derived and/or modified sequence opt5 from neuraminidase__InfluenzaA__AJJ98911

SEQ ID NO: 208910 - RNA, 1410 nt, Artificial Sequence; identical to SEQ ID NO: 205946
  derived and/or modified sequence opt5 from neuraminidase__InfluenzaA__AJJ98923

SEQ ID NO: 208911 - RNA, 1410 nt, Artificial Sequence
  derived and/or modified sequence opt5 from neuraminidase__InfluenzaA__AJJ98935
augaaccccaaucagaagaucauuaccaucggcagcgugucccugacaauuucuacgaucugcuucuuuaugcaaauugccauccucaucaccacagucacccugcacuucaaaagauacgaguuuaacagcccuccgaauaaccagguuaugcuuugugaacccacaauuaucgagcggaauauuaccgaaaucguguaucugacaaacaccacgauugagaaggaaaucugcccuaaacccgcugaguaccgcaauugguccaagccucagugugggauuaccggauucgcccccuuuucuaaagacaacagcaucagacucuccgcgggcggggauaucugggugacacgggagccuuaugucucuugcgacccggauaaguguuaccaguucgcucugggacaaggcaccacacuuaauaacgugcauagcaauaacaccguucgcgacagaacgcccuaucggacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcgccugguugacucuguggucuccuggagcaaagagauccuuagaacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcagcacguggaggaaugcuccugcuauccccgguacccuggggugcgcugugucugcagagauaacuggaagggaagcaaucggcccaucguggacauuaacaucaaagaucacucuauuguuuccagcuacguguguucuggccuggucggcgacaccccgcgcaagaaugacagcuccucuagcucccauugccuugauccuaacaaugaggaagggggacacggcgugaaagggugggccuucgacgauggaaacgacguuuggaugggcagaacgaucaaugagacaagccggcugggguaugagaccuuuaaggugaucgaaggauggucuaaccccaaauccaagcuccaaauuaaucgccaggucaucguggauagaggcgaccggagcggcuacucugggauuuucuccgucgagggaaaaagcuguaucaacagaugcuuuuauguggaacugauucgcggccggaaggaggaaaccgagguucuguggacauccaauucuaucguggucuucugugggaccagcggaacauacggcacgggguccuggccugauggcgcugaccucaaccugaugcccauuuga

SEQ ID NO: 208912 - RNA, 1410 nt, Artificial Sequence
  derived and/or modified sequence opt5 from neuraminidase__InfluenzaA__AJJ98947
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuacacuuugugaacccaccauuaucgagagaaauauuacagaaaucguguaucugaccaacacgaccauugagaaggaaaucugcccuaaacucgcugaguaccggaauugguccaagccccagugugacauuacaggguucgccccuuuuucuaaagauaacagcauccgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcauugccugguccucuagcuccugucaugacggaaaagccuggcugcacgugugcaucaccggcaacgauaagaaugcuaccgccagcuucauuuacaacggccggcuuguugacucuguggucuccuggagcaaagagauccugcgcacacaggaaucugagugugugugcauuaacgggacguguaccguggucaugacagauggauccgcuagcggcaaggccgacaccaaaauccucuuuaucgaggaagggaagauuguucauacauccacccugucuggaagcgcgcaacacguggaggaaugcuccugcuauccuagauaccccggcgugcggugugucugccgcgauaauuggaaggggagcaacagaccuaucguggacauuaauaucaaagaucacucuauuguuuccagcuacguguguucuggacuugucggcgacacgccccggaagaacgacagcuccucuagcucccauugccuggauccgaauaacgaggaaggcgggcacggagugaaaggcugggccuucgacgaugggaaugacguuuggaugggacgcacaaucaacgagaccagcagacucggcuaugagaccuuuaaggugaucgaaggguggucuaauccuaaauccaagcugcagauuaaccggcaggucaucguggaucgcggaaauagaagcggcuacucuggcauuuucuccgucgaggggaaaagcuguaucaaccggugcuuuuauguggaacugauuagaggacgcaaggaggaaacagagguucucuggaccuccaauucuaucguggucuucuguggcacaagcgggacguacggaaccggcuccuggcccgacggggcugaucugaaccuuaugccuauuuga

SEQ ID NO: 208913 - RNA, 1410 nt, Artificial Sequence
  derived and/or modified sequence opt5 from neuraminidase__InfluenzaA__AJJ98971
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugccuaucuga

SEQ ID NO: 208914 - RNA, 1410 nt, Artificial Sequence
  derived and/or modified sequence opt5 from neuraminidase__InfluenzaA__AJJ98995
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaucguucgggaucgcacccccuauagaacgcugcucaugaaugaacugggcgugccuuuucaccuggggacaaagcaggucugcauugccugguccucuagcuccugucaugacggaaaagccuggcuccacgugugcaucaccggcgaugacaagaacgcuacagccagcuucauuuacaauggccggcugguugauucuguggucuccuggagcaaagagauccuucgcacccaggaaucugagugugugugcauuaacgggaccuguacaguggucaugacggacggauccgcuagcggcaaggccgauaccaaaauccuguuuaucgaggaagggaagauuguucauacauccacccucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacacaccgcggaagaaugauagcuccucuagcucccauugccuugacccuaacaaugaggaaggcgggcacggagugaaaggcugggccuucgaugacgggaacgauguuuggaugggacgcaccaucaaugagacgagcagacugggcuaugagacauuuaaggugaucgaaggguggucuaaccccaaauccaagcuccagauuaaucggcaggucaucguggaccgcagcgauagaucuggauacuccggcauuuucagcgucgagggcaaauccuguaucaaccggugcuuuuauguggaacugauuagagggcgcaaggaggaaaccgagguucuguggaccucuaauagcaucguggucuucuguggaacauccggcaccuacgggacaggaucuuggccugacggcgcugaucucaaccugaugcccauuuga

SEQ ID NO: 208915 - RNA, 1410 nt, Artificial Sequence; identical to SEQ ID NO: 204167
  derived and/or modified sequence opt5 from neuraminidase__InfluenzaA__AJJ99007

SEQ ID NO: 208916 - RNA, 1410 nt, Artificial Sequence
  derived and/or modified sequence opt5 from neuraminidase__InfluenzaA__AJJ99019
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggaucgcacaccguacagaacccuccugaugaaugaacugggcgugcccuuucaccucgggacaaagcaggucuguaucgccugguccagcagcuccugccaugacggaaaagccuggcugcacguguguauuaccggcgaugacaagaacgcuaccgccagcuucaucuauaauggccggcuuguugauucuguggucuccuggagcaaagagauucugcgcacacaggaaucugagugcguguguaucaacgggacgugcaccguggucaugacagacggauccgcuagcggcaaggccgauaccaaaauucucuuuaucgaggaagggaagaucguucauacauccacccugucuggaagcgcgcaacacguggaggaaugcuccuguuacccuagauaucccggcgugcggugcgucugucgcgacaacuggaaggggagcaauagaccuauuguggauaucaacauuaaagaccacucuaucguuuccaauuacgugugcagcggacuugucggcgacacgccccggaagaacgauucuagcuccucuagccauugucuggacccgaauaacgaggaaggcgggcacggagugaaaggcugggccuucgaugacgggaaugauguuuggaugggacgcacaauuuccgagaagucuagauuuggcuacgagaccuucaaagugaucgaaggguggucuaacccuaaguccaaacuccagaucaaucggcaggucauuguggaccgcggaaacagaagcggcuauucuggcaucuuuuccgucgagggaaagagcugcauuaaucgguguuucuacguggaacugaucagagggcgcaaggaggaaaccgagguucuguggacauccaacucuauuguggucuucugcggcaccagcgggacauauggaacgggcuccuggcccgauggggcugacaucaaucucaugccuauuuga

SEQ ID NO: 208917 - RNA, 1410 nt, Artificial Sequence
  derived and/or modified sequence opt5 from neuraminidase__InfluenzaA__AJJ99031
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacaauuaauaacgugcauagcaaugauaccguucgggaccgcacgccguauagaacacugcucaugaacgaacugggcgugcccuuucaccuggggaccaagcaggucugcaucgccugguccucuagcuccugucaugauggaaaagccuggcuccacgugugcauuacaggcgacgauaagaaugcuaccgccagcuucaucuacaacggccggcugguugacucuguggucuccuggagcaaagagauucuucgcacccaggaaucugagugugugugcaucaaugggacauguacgguggucaugaccgauggauccgcuagcggcaaggccgacacaaaaauccuguuuauugaggaagggaagaucguucauaccuccacacucucuggaagcgcgcaacacguggaggaaugcuccugcuauccuagauaccccggcgugcggugugucugccgcgauaacuggaaggggagcaacagaccuauuguggacaucaauauuaaagaccacucuaucguuuccagcuacguguguucuggacuggucggcgauacgccccggaagaacgacagcuccucuagcucccauugccuugauccgaauaacgaggaaggcgggcacggagugaaaggcugggccuucgacgaugggaaugacguuuggaugggacgcaccaucagcgagaagucuagacugggcuaugagacauuuaaagugauugaagggugguccaacccuaagagcaaacuccagaucaaucggcaggucauuguggaucgcggaaacagaucuggcuacuccggcaucuucagcgucgaggggaaguccuguauuaaucggugcuuuuauguggaacugaucagaggacgcaaggaggaaaccgagguucuguggaccucuaacagcauuguggucuucuguggcacauccgggaccuacggaacaggcucuuggcccgacggggcugauaucaaucucaugccuaucuga

SEQ ID NO: 208918 - RNA, 1410 nt, Artificial Sequence
  derived and/or modified sequence opt5 from neuraminidase__InfluenzaA__AJJ99043
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccagcagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagauaccccggcgugcggugugucugccgcgacaacuggagagggagcaaccggccuaucguggauauuaauaugaaagacuacucuaucguuuccagcuauguguguucuggacuugucggcgacacgccccgcaagaacgauagcuccucuagcggccacugccuggacccgaauaacgaggaagggggacauggcgugaaagggugggccuucgaugacggaaaugauguuuggaugggcagaaccauuuccgagaagucucggucuggguacgagacauuuaaagugaucgaaggaugguccaacccuaauagcaagcuccagaucaaccgccaggucauuguggacagaggcaaucggucuggcuauuccgggaucuucagcgucgagggaaaauccuguauuaacagaugcuuuuacguggaacugauccgcggccggaaggaggaaaccgagguucuguggaccucuaauagcauuguggucuucugugggacauccggaaccuauggcacagggucuuggcccgauggcgcugacaucaaccucaugccuauuuga

SEQ ID NO: 208919 - RNA, 1410 nt, Artificial Sequence
  derived and/or modified sequence opt5 from neuraminidase__InfluenzaA__AJJ99067
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggggcgcacgcccuauagaacacugcucaugaaugaacugggagugccuuuucaccugggcaccaagcaggucugcauugccugguccucuagcuccugucaugacggcaaagccuggcuccacgugugcaucacaggggaugacaagaacgcuaccgccagcuucauuuacaauggacggcugguugauucuguggucuccuggagcaaagacauccuucgcacccaggagucugaaugugugugcauuaacggcacauguacgguggucaugaccgauggguccgcuagcggaaaggccgacacaaaaauccuguuuaucgaggagggcaagauuguucauaccuccacacucucugggagcgcgcaacacguggaagagugcuccugcuaucccagauacccuggagugcggugugucugccgcgauaacuggaagggcagcaauagacccaucguggacauuaacaucaaagaucacucuauuguuuccagcuacguguguucuggccuggucggggacaccccgcggaagaaugacagcuccucuagcucccauugccuugauccuaacaaugaagagggaggccacggggugaaaggaugggccuucgacgauggcaacgacguuuggauggggcgcacgaucaaugaaacaagcagacugggauaugagaccuuuaaggugaucgagggcuggucuaaccccaaauccaagcuccagauuaaucggcaggucaucguggaucgcggcgacagaagcggguacucuggaauuuucuccgucgaaggcaaaagcuguaucaaccggugcuuuuauguggagcugauuagagggcgcaaggaagagaccgaaguucuguggacauccaauucuaucguggucuucuguggaaccagcggcacauacgggacgggcuccuggccugauggagcugaccucaaccugaugcccauuuga

SEQ ID NO: 208920 - RNA, 1410 nt, Artificial Sequence
  derived and/or modified sequence opt5 from neuraminidase__InfluenzaA__AJJ99079
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucggaaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaacggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaauuggaagggaagcaacagacccaucguggauauuaauaucaaagaccacucuauuguuuccagcuacguguguucuggccuggucggcgauaccccgcggaagaacgacagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 208921 - RNA, 1410 nt, Artificial Sequence
  derived and/or modified sequence opt5 from neuraminidase__InfluenzaA__AJJ99091
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgaccuguggaugggccgcacgaucaaugagacaagcagacucggguaugagaccuuuaagguuaucgaaggauggucuaaccccaaauccaagcugcagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcucuggacauccaauucuaucguuguguucugugggaccagcggaacauacggcacgggguccuggccugauggcgcugaccugaaccuuaugcccauuuga

SEQ ID NO: 208922 - RNA, 1410 nt, Artificial Sequence
  derived and/or modified sequence opt5 from neuraminidase__InfluenzaA__AJJ99103
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucggaaucgcacgcccuauagaacacugcucaugaacgaacugggcgugccuuuucaccuggggaccaagcaggucugcaucgccugguccucuagcuccugucaugauggaaaagccuggcuccacgugugcauuacaggcgacgauaagaaugcuaccgccagcuucaucuacaacggccggcugguugacucuguggucuccuggagcaaagagauucuucgcacccaggaaucugagugugugugcaucaacgggacauguacgguggucaugaccgauggauccgcuagcggcaaggccgacacaaaaauucuguuuaucgaggaagggaagaucguucauaccuccacacucucuggaagcgcgcaacacguggaggaaugcuccugcuaucccagauacccuggcgugcggugugucugccgcgauaauuggaaggggagcaacagacccauuguggacaucaauauuaaagaucacucuaucguuuccagcuacguguguucuggacuggucggcgacaccccgcggaagaacgacagcuccucuagcucccauugccuugauccuaauaacgaggaaggcgggcacggagugaaaggcugggccuucgacgaugggaaugacguuuggaugggacgcacgauuaacgagacaagcagacugggcuaugagaccuuuaaggugaucgaaggguggucuaaucccaaauccaagcuccagaucaaccggcaggucauuguggaucgcagcgacagaucuggauacuccggcaucuucagcgucgagggcaaauccuguauuaaucggugcuuuuauguggaacugaucagagggcgcaaggaggaaaccgagguucuguggacaucuaacagcauuguggucuucuguggaaccuccggcacauacgggacgggaucuuggccugauggcgcugaccucaaucugaugcccaucuga

SEQ ID NO: 208923 - RNA, 1410 nt, Artificial Sequence; identical to SEQ ID NO: 208389
  derived and/or modified sequence opt5 from neuraminidase__InfluenzaA__AJJ99115

SEQ ID NO: 208924 - RNA, 1410 nt, Artificial Sequence; identical to SEQ ID NO: 207309
  derived and/or modified sequence opt5 from neuraminidase__InfluenzaA__AJJ99127

SEQ ID NO: 208925 - RNA, 1410 nt, Artificial Sequence; identical to SEQ ID NO: 208597
  derived and/or modified sequence opt5 from neuraminidase__InfluenzaA__AJJ99139

SEQ ID NO: 208926 - RNA, 1410 nt, Artificial Sequence
  derived and/or modified sequence opt5 from neuraminidase__InfluenzaA__AJJ99151
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucagcgagaagucuagacugggcuaugagacauuuaaagugaucgaagggugguccaaucccaagagcaaacuccagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucuguggaccucuaauagcaucguggucuucuguggcacauccgggaccuacggaacaggcucuuggccugauggggcugacauuaaccucaugcccaucuga

SEQ ID NO: 208927 - RNA, 1410 nt, Artificial Sequence; identical to SEQ ID NO: 199623
  derived and/or modified sequence opt5 from neuraminidase__InfluenzaA__AJJ99163

SEQ ID NO: 208928 - RNA, 1410 nt, Artificial Sequence
  derived and/or modified sequence opt5 from neuraminidase__InfluenzaA__AJJ99175
augaaccccaaucagaagaucauuaccaucggcagcgugucccugacaauuucuacgaucugccucuucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguuugccccuuucucuaaagauaacagcauccgccuuuccgcgggaggcgacaucugggugacaagagagcccuaugucucuugcgauccugacaaguguuaccaauuugcucuggggcagggaaccacacucaauaacgugcauagcaauaacaccguucgggaucgcacgccguauagaacacugcugaugaaugaacucggcgugcccuuccaccuggggaccaagcaggucugcauugccugguccucuagcuccugucaugacggaaaagccuggcuucacgugugcaucacaggcgaugacaagaacgcuaccgccagcuuuauuuacaauggccggcugguugauucuguggucuccuggagcaaagagauccuccgcacccaggaaucugagugugugugcauuaacgggacauguacgguggucaugaccgacggauccgcuagcggcaaggccgauacaaaaauccuguucaucgaggaagggaagauuguucauaccuccacacuuucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuggucggcgacacgccccggaagaaugauagcuccucuagcucccauugccucgacccgaacaaugaggaaggcgggcacggagugaaaggcugggccuuugaugacgggaacgauguuuggaugggacgcaccaucagcgagaagucuagacugggcuaugagacauucaaagugaucgaagggugguccaauccuaagagcaaacugcagauuaaccggcaggucaucguggaccgcggaaauagaucuggcuacuccggcauuuuuagcgucgaggggaaguccuguaucaaccggugcuucuauguggaacucauuagaggacgcaaggaggaaaccgagguucuguggaccucuaauagcaucguggucuuuuguggcacauccgggaccuacggaacaggcucuuggcccgaugggacggacauuaaccuuaugccuaucuga

SEQ ID NO: 208929 - RNA, 1410 nt, Artificial Sequence
  derived and/or modified sequence opt5 from neuraminidase__InfluenzaA__AJJ99199
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaucuggcuacuccggcaucuucagcguggaggggaaguccuguauuaaccggugcuuuuaugucgaacugaucagaggacgcaaggaggaaaccgaggugcucuggaccucuaauagcauuguuguguucuguggcacauccgggaccuacggaacaggcucuuggcccgauggggcugacaucaaccugaugccuaucuga

SEQ ID NO: 208930 - RNA, 1410 nt, Artificial Sequence; identical to SEQ ID NO: 199767
  derived and/or modified sequence opt5 from neuraminidase__InfluenzaA__AJJ99211

SEQ ID NO: 208931 - RNA, 1410 nt, Artificial Sequence
  derived and/or modified sequence opt5 from neuraminidase__InfluenzaA__AJJ99223
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcgaggccgauacaaagauccucuuuauugaagaggggaaaaucguccauaccuccacacugucuggaagcgcgcaacacguugaagagugcuccugcuauccuagauaccccggcgugcggugugugugccgcgacaacuggaaggggagcaauagaccuauugucgauaucaacauuaaggaccacucuaucguguccagcuacguuuguucuggacuugugggcgacacgccccggaaaaaugauagcuccucuagcucccauugccuggacccgaacaaugaagagggcgggcacggagucaagggcugggccuucgaugacgggaacgauguguggguuggacgcaccaucagcgagaaaucuagacucggcuaugaaacauuuaaggugauugaggggugguccaauccuaaaagcaagcugcagaucaaccggcaggucauuguggaccgcggaaauagaucuggcuacuccggcaucuucagcgucgaagggaaauccuguauuaaccggugcuuuuauguggagcugaucagaggacgcaaggaagagaccgagguucucuggaccucuaauagcauuguggucuucuguggcacauccgggaccuacggaacaggcucuuggcccgauggggcugacaucaaccugaugccuaucuga

SEQ ID NO: 208932 - RNA, 1410 nt, Artificial Sequence
  derived and/or modified sequence opt5 from neuraminidase__InfluenzaA__AJJ99235
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaaugauaccguucgggaccgcacgcccuauagaacacugcucaugaacgaacugggcgugccuuuucaccuggggaccaagcaggucugcauugccugguccucuagcuccugucaugauggaaaagccuggcuccacgugugcaucacaggcgacgauaagaaugcuaccgccagcuucauuuacaacggccggcugguugacucuaucguguccuggagcaaagagauucuucgcacccaggaaucugagugugucugcaucaaugggacauguacgguggugaugaccgauggauccgcuagcggcgaggccgacacaaagauccuguuuauugaagaggggaaaaucguccauaccuccacacucucuggaagcgcgcaacacguugaagagugcuccugcuaucccagauacccuggcgugcggugugugugccgcgauaacuggaaggggagcaacagacccauugucgacaucaauauuaaggaccacucuaucguguccagcuacguuuguucuggacuggugggcgauaccccgcggaaaaacgacagcuccucuagcucccauugccuugauccuaauaacgaagagggcgggcacggagucaagggcugggccuucgacgaugggaaugacguguggaugggacgcacgaucagcgagaaaucuagacugggcuaugaaacauuuaagguuauugaggggugguccaaccccaaaagcaagcuccagaucaaucgccaggugauugucgaucggggaaacagaucuggcuacuccggcaucuucagcguggaagggaaauccuguauuaaucggugcuuuuaugucgagcugaucagaggacgcaaggaagagaccgaggugcuguggaccucuaacagcauuguuguguucuguggcacauccgggaccuacggaacaggcucuuggccugacggggcugauaucaaucucaugcccaucuga

SEQ ID NO: 208933 - RNA, 1410 nt, Artificial Sequence
  derived and/or modified sequence opt5 from neuraminidase__InfluenzaA__AJJ99246
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaaacgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauagcggagcugucgccgugcugaaguauaacggcaucauuacagacaccaucaagucuuggagaaauaacauucuccggacacaagaguccgagugugcgugccugaaugggagcuguuucaccaucaugacggauggaccgucugacggccaggccagcuacaaaauuuuucgcaucgaaaagggcaaaaucgugaaguccgucgagaugaacgcucccaauuaucauuacgaagagugcucuuguuacccugauagcuccgagauuacaugcguuugcagagacaacuggcacgggagcaaucggcccugggugucuuucaaccagaaucuugaauaucagaucggauacauuuguuccggcaucuuuggggauaacccucgccccaaugacaaaaccggaagcugcggcccggugucuuccagcggggccaacggagucaagggcuucuccuuuaaguauggcaaugggguguggauuggaagaacaaaaucuaucagcucccggaagggcuucgagaugauuugggauccuaacggguggaccggaaccgacaacaauuuuucuaucaaacaagacaucguuggcauuaacgaauggagcggguacuccggcagcuucgugcagcaucccgagcugacaggacucgauuguauccgcccuugcuucugggucgaacugauuagaggccggcccaaggagaauacgaucuggaccucuggguccagcauuucuuuuuguggagugaacuccgacacaguuggcuggagcuggcccgauggggcugagcuuccuuucaccaucgacaaauga

SEQ ID NO: 208934 - RNA, 1410 nt, Artificial Sequence
  derived and/or modified sequence opt5 from neuraminidase__InfluenzaA__AJJ99257
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugccuagcaauggggccaacggagucaagggcuucucuuuuaaguauggcaacgggguguggaucggaagaacaaaauccauuagcucccggaagggcuucgagaugaucugggaucccaauggguggaccggaaccgacaacucuuuuagcaucaaacaagacauuguuggcacaaaugaaugguccggguacucuggcagcuucgugcagcauccugagcuuacgggacuggauuguauccgccccugcuucugggucgaacucauuagaggccggcccaaggagaacaccaucuggacauccgggagcucuauuuccuuuuguggagugaauagcggcaccguuggguggucuuggccugacggagcugagcugccguucacaaucgauaaauga

SEQ ID NO: 208935 - RNA, 1413 nt, Artificial Sequence; identical to SEQ ID NO: 199656
  derived and/or modified sequence opt5 from neuraminidase__InfluenzaA__AJJ99269

SEQ ID NO: 208936 - RNA, 1410 nt, Artificial Sequence; identical to SEQ ID NO: 203982
  derived and/or modified sequence opt5 from neuraminidase__InfluenzaA__AJJ99280

SEQ ID NO: 208937 - RNA, 1410 nt, Artificial Sequence; identical to SEQ ID NO: 203733
  derived and/or modified sequence opt5 from neuraminidase__InfluenzaA__AJJ99291

SEQ ID NO: 208938 - RNA, 1413 nt, Artificial Sequence
  derived and/or modified sequence opt5 from neuraminidase__InfluenzaA__AJJ99303
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccauggagcugaacgcuccuaauuuucauuaugaagaguguucuugcuacccggacaccggcaucgucaugugugugugccgggauaacuggcacgggagcaaucgccccuggguguccuucaaccagaaucuugacuaccaaauuggauauaucugcagcggcgucuuuggggauaacccuagacccgaggacggagaaggcucuuguaauccuguuaccguggauggcgccaacggggugaaaggauucuccuacaaguaugacaauggcgucuggauugggcggacaaaaagcaaccgccugagaaagggauuugagaugaucugggaccccaauggcuggacgaacaccgauucugacuucuccgugaaacaggauguuguggcgauuacagacuggagcggguacuccggcucuuuuguccagcacccggaacucaccggacuggauugcauccggccuuguuucuggguggagcuuguucgcggccugcccagagaaaacacaaccaucuggacgagcggguccucuauuagcuucugcggagucaauuccgacacagccaacuggagcuggccugauggcgcugagcuccccuuuaccaucgacaaguga

SEQ ID NO: 208939 - RNA, 1410 nt, Artificial Sequence
  derived and/or modified sequence opt5 from neuraminidase__InfluenzaA__AJJ99314
augaaccccaaucagaagaucauuaccaucggcagcgccugcaugacaauugggauggcuaaccugauccuccaaauuggaaauaucaucuccauuuggaucucucacagcauucagcugggcaaccagaaucagaucgagacguguaaccaauccgugauuaccuacgaaaauaacacaugggucaaucagaccuauguuaacaucucuaauacaaacuucgccgcggggcagagcgugguguccgucaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggccgagcugccuuucaccaucgacaaguga

SEQ ID NO: 208940 - RNA, 1413 nt, Artificial Sequence
  derived and/or modified sequence opt5 from neuraminidase__InfluenzaA__AJJ99326
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggccugggguggcugaccaucggaauuagcggcccugacaacggggcggucgccgugcucaaguauaauggaaucauuacaggcaccaucaaaucuuggaagaaacagauucugagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcuuaacgcuccuaauuuuuauuacgaagaguguucuugcuacccggacaccggcauugucaugugugugugccgggauaacuggcaugggagcaaucgccccuggguguccuucaaccagaaucuggacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccucagaaagggcuuugagaugauuugggaccccaauggguggacgaacaccgacucugauuucuccgugaaacaggacguuguggcgaucacagauuggagcggcuauuccggaucuuuuguccagcacccggaacugaccggccuugacugcauccggccuuguuucuggguggagcugguucgcgggcuccccagagaaaacacaaccauuuggacgagcggauccucuaucagcuucugcggcgucaauuccgauacagccaacuggagcuggccugacggggcugagcugcccuuuaccauugauaaguga

SEQ ID NO: 208941 - RNA, 1410 nt, Artificial Sequence; identical to SEQ ID NO: 201406
  derived and/or modified sequence opt5 from neuraminidase__InfluenzaA__AJJ99337

SEQ ID NO: 208942 - RNA, 1410 nt, Artificial Sequence; identical to SEQ ID NO: 200869
  derived and/or modified sequence opt5 from neuraminidase__InfluenzaA__AJJ99348

SEQ ID NO: 208943 - RNA, 1410 nt, Artificial Sequence; identical to SEQ ID NO: 199762
  derived and/or modified sequence opt5 from neuraminidase__InfluenzaA__AJJ99359

SEQ ID NO: 208944 - RNA, 1410 nt, Artificial Sequence
  derived and/or modified sequence opt5 from neuraminidase__InfluenzaA__AJJ99370
augaaccccaaucagaagaucauuaccaucggcagcgugugcaugauuaucgggauggccaaccugauucuccaaaucggaaauaucauuuccaucuggauuucucacagcauccagcugggcaaccagucccagauugagacauguaaucaaucugucaucacguacgaaaacaauaccuggguuaaccagacauaugugaauauuagcaacaccaauuucgcugccgggcaguccguggucucugugaaacuugcgggaaacagcucccugugcccuguuagcggcugggcuaucuacucuaaggacaauuccaucagaauugggagcaaaggagauguguuugucauccgggagccguucauuucuuguucuccccucgaaugccgcacauuuuuccugacccagggcgcccuucugaacgacaagcauagcaauggcacaaucaaagauagaucuccucaccggacccucauguccugucccauuggggaggugccuagccccuauaacucccgcuuugaaucuguugccuggagcgcuuccgccugccaugacggaaucaacuggcugacgaucggcauuagcgggccugauaauggagcuguggccguccugaaguacaacggcaucauuaccgacacaaucaagucuuggagaaauaacauucuccggacccaagaguccgagugugcgugcgugaaugggagcuguuucacaaucaugaccgauggaccgucugaccgccaggccagcuauaaaaucuuuagaauugaaaagggcaaaaucgugaaguccgucgagaugaacgcucccaauuaccacuaugaagagugcucuuguuacccugauagcuccgagauuacgugcguuugccgggacaacuggcauggcagcaaucgccccugggugucuuucaaccagaaucuggaauaccagaucggguauauuuguuccggaaucuuuggcgauaacccuagacccaaugacaaaacagggagcugcggaccggugucuuccaacggcgccaauggggucaagggauucagcuuuaaguacggcaacggcguguggauugggcggaccaaauccaucucuagccgcaagggauucgagaugaucugggauccuaacggcuggacagggaccgacaauaacuuuuccauuaaacaagacaucguuggaauuaaugaauggucuggcuauagcggguccuucgugcagcaccccgagcuuaccggccuggauuguaucagaccuugcuucugggucgaacucauucggggacgccccaaggagaacacaaucuggacgagcggcuccuccaucagcuuuugugggguuaauucugacaccgugggaugguccuggcccgauggcgcugagcugccuuucacaauugacaaauga

SEQ ID NO: 208945 - RNA, 1410 nt, Artificial Sequence; identical to SEQ ID NO: 203281
  derived and/or modified sequence opt5 from neuraminidase__InfluenzaA__AJJ99381

SEQ ID NO: 208946 - RNA, 1410 nt, Artificial Sequence
  derived and/or modified sequence opt5 from neuraminidase__InfluenzaA__AJJ99392
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcccuaauggggccaacggagugaagggcuucucuuuuaaguauggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccgacacagugggcuggagcuggccugauggggcuaagcugccguucaccaucgacaaauga

SEQ ID NO: 208947 - RNA, 1410 nt, Artificial Sequence; identical to SEQ ID NO: 199762
  derived and/or modified sequence opt5 from neuraminidase__InfluenzaA__AJJ99403

SEQ ID NO: 208948 - RNA, 1413 nt, Artificial Sequence; identical to SEQ ID NO: 200485
  derived and/or modified sequence opt5 from neuraminidase__InfluenzaA__AJJ99415

SEQ ID NO: 208949 - RNA, 1413 nt, Artificial Sequence
  derived and/or modified sequence opt5 from neuraminidase__InfluenzaA__AJJ99427
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcugucuacaccaaggauaauuccauccggauuggaagcaaaggcgacguguucguuauccgcgagccuuuuauuucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucugucgccuggagcgcuuccgccugucacgauggcaugggguggcugaccaucggaaucagcggcccugacaacggggcgguggccguucugaaguauaauggaauuaucacaggcaccauuaaaucuuggaagaaacagauccucagaacgcaggaguccgagugcguguguaugaacggcagcugcuuuacaauuaugaccgaugggcccucugacaaggcugccagcuacaaaaucuucaagaucgaaaagggaaaagucacaaaguccauugagcugaaugcuccuaacuuuuauuacgaagaguguucuugcuacccggauaccggcaucgugaugugugugugccgggacaauuggcaugggagcaaccgccccugggucuccuucaaucagaaccuugauuaucaaauuggauacaucugcagcggcguuuuuggggacaauccuagacccgaggauggagaaggcucuuguaacccugugaccguggacggcgccaauggggucaaaggauucuccuauaaguacggcaacgggguguggauuggacggacaaaaagcaaucgccugagaaagggcuuugagaugaucugggaccccaacggguggauuaauacggauucugacuucuccguuaaacaggauguggucgcgaucaccgacuggagcggcuauuccggaucuuuugugcagcacccggaacucacaggccuggauugcauccggccuuguuucuggguugagcuugugcgcgggcugcccagagaaaacaccacaauuuggaccagcggauccucuaucagcuucugcggcgucaacuccgacacggccaauuggagcuggccugauggggcugagcuccccuuuacaauugacaaguga

SEQ ID NO: 208950 - RNA, 1413 nt, Artificial Sequence
  derived and/or modified sequence opt5 from neuraminidase__InfluenzaA__AJJ99439
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcaccucugggugggcuauuuacacgaaggauaauuccauccggauuggaagcaaaggcgacgucuucgugauccgcgagccuuuuauuucuugcucccaccuggaauguagaaccuucuuucucacacaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaaucagcggcccugacaacggggcggucgccgugcugaaguauaauggaauuaucaccggcacgauuaaaucuuggaagaaacagauccucagaacacaggaguccgagugcguuuguaugaacggcagcugcuuuaccauuaugacagaugggcccucuaauaaggcugccagcuacaaaaucuucaagaucgaaaagggaaaagugaccaaguccauugagcugaacgcuccuaauuuuuauuacgaagaguguucuugcuacccggacaccggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuacaguggauggcgccaacggggugaaaggauucuccuauaaguacggcaauggggucuggauuggacggacgaaaagcaaccgccugagaaagggcuuugagaugaucugggaccccaauggguggaccaacacagacucugauuucuccgugaaacaggacguuguggcgauuaccgauuggagcggcuauuccggaucuuuuguccagcacccggaacucacaggccuggacugcauccggccuuguuucuggguggagcuuguucgcgggcugcccagagaaaacaccacgaucuggacaagcggauccucuauuagcuucugcggcgucaauuccgauaccgccaacuggagcuggccugacggggcugagcuccccuuuaccaucgauaaguga

SEQ ID NO: 208951 - RNA, 1413 nt, Artificial Sequence
  derived and/or modified sequence opt5 from neuraminidase__InfluenzaA__AJJ99451
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaucggacaguuaaagaccgcucuccguauagagcccugauguccugcccccucggggaggcuccuagccccuacaacuccaaguucgaaucuguggccuggagcgcuuccgccugucacgauggaaugggcuggcugaccaucgggauuagcggaccugacaacggcgcggucgccgugcugaaguauaaugggaucauuacaggaaccaucaaaucuuggaagaaacagauucuccggacgcaggaguccgagugcguuuguaugaacggcagcugcuuuacaaucaugaccgauggccccucuaauaaggcugccagcuacaaaaucuucaagauugaaaaggggaaagugacaaaguccaucgagcugaacgcuccuaauuuucauuaugaagaguguucuugcuacccggacaccggaauugucaugugugugugccgcgauaacuggcacggcagcaauagacccuggguguccuucaaccagaaucuugacuaccaaaucggguauauuugcagcggagucuuuggcgauaacccucggcccgaggacggggaaggaucuuguaauccuguuaccguggauggcgccaacggcgugaaaggguucuccuacaaguaugacaauggagucuggaucggccgcacaaaaagcaacagacugcggaagggguuugagaugauuugggaccccaauggauggacgaacaccgauucugacuucuccgugaaacaggauguuguggcgaucacagacuggagcggcuacuccgggucuuuuguccagcacccggaacucaccggccuggauugcauccgcccuuguuucuggguggagcuuguuagaggacugccccgggaaaacacaaccauuuggacgagcggcuccucuaucagcuucugcggggucaauuccgacacagccaacuggagcuggccugauggagcugagcuccccuuuaccauugacaaguga

SEQ ID NO: 208952 - RNA, 1413 nt, Artificial Sequence; identical to SEQ ID NO: 199656
  derived and/or modified sequence opt5 from neuraminidase__InfluenzaA__AJJ99463

SEQ ID NO: 208953 - RNA, 1410 nt, Artificial Sequence
  derived and/or modified sequence opt5 from neuraminidase__InfluenzaA__AJJ99474
augaaccccaaucagaagaucauuaccaucggcagcgugugcaugacaauugggaucgccaaccugauucuccaaaucggaaauaucauuuccaucuggauuucucacagcauccagcugggcaaccagaaucagauugagacguguaaccaauccgucaucauuuacgaaaauaacaccuggguuaaucagacauaugugaacaucucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugccuggucugcuagcgccugccacgacggaaucaauuggcugacgauuggcaucuccgggccugauaacggagcuguggccguccugaaguauaauggcauuaucaccgacacaauuaagagcuggagaaacaauauccuccggacccaagagucugagugugcgugcgugaacggguccuguuucacaaucaugaccgauggaccgagcgacggccaggccucuuacaaaauuuuucgcaucgaaaagggcaaaauuaucaagagcguggagaugaaugcucccaacuaucauuacgaagagugcuccuguuacccugauucuagcgagauuacgugcgucugcagagacaauuggcacggguccaaccggcccuggguuagcuucaaucagaaccuggaauaucagaucggauacauuuguucuggcaucuuuggggauaauccucgccccaacgacaaaacaggauccugcggcccggugagcucuaauggggccaacggagugaagggcuucuccuuuaaguauggcaacggggucuggaucggaagaaccaaaagcauuuccucucggaagggcuucgagaugaucugggauccuaauggguggacaggaaccgacaacagcuuuuccauuaaacaagacaucgugggcauuaaugaauggucuggguacagcggcuccuucguucagcaucccgagcuuaccggacuggauuguauccgcccuugcuucuggguggaacucaucagaggccggcccaaggagaacacaauuuggacgagcgggucuuccaucagcuuuuguggagucaauucuggcaccguggggugguccuggcccgacggagcugagcugccuuucacaauugauaaauga

SEQ ID NO: 208954 - RNA, 1410 nt, Artificial Sequence; identical to SEQ ID NO: 203733
  derived and/or modified sequence opt5 from neuraminidase__InfluenzaA__AJJ99496

SEQ ID NO: 208955 - RNA, 1410 nt, Artificial Sequence
  derived and/or modified sequence opt5 from neuraminidase__InfluenzaA__AJJ99507
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggggccaaccggcccuggguguccuucaaucagaaccuggaauaucagaucggauacauuuguagcggcaucuuuggggauaauccucgccccaacgacaaaaccggaucuugcggcccggucuccagcaauggggcuaacggagugaagggcuucucuuuuaaguaugauaacggcguuuggauugggagaacaaaauccaucagcucccggaauggauucgagaugauuugggacccuaacggcuggaccgggaccgacaaugauuuuucuaucaagcaagacaucgugggaauuaacgaauggagcggcuacuccgggucuuucguccagcaucccgagcuuacaggccuggauuguauccgcccuugcuucuggguggaacucauuagaggacggcccaaagagaauacgaucuggaccagcggcuccagcauuucuuuuugugggguuaacuccgacacagugggauggagcuggcccgauggcgccgagcugccuuucaccaucgacaaguga

SEQ ID NO: 208956 - RNA, 1410 nt, Artificial Sequence; identical to SEQ ID NO: 199762
  derived and/or modified sequence opt5 from neuraminidase__InfluenzaA__AJJ99518

SEQ ID NO: 208957 - RNA, 1410 nt, Artificial Sequence
  derived and/or modified sequence opt5 from neuraminidase__InfluenzaA__AJJ99529
augaaccccaaucagaagaucauuaccaucggcagcgugugcaugacaauugggauggccaaccugauccuccaagucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggauucaauuggcugaccaucggcauuuccgggccugauaacggagcugucgccgugcugaaguauaauggcaucaucacagacaccauuaagagcuggagaaacaauauccuccggacacaagagucugagugugcgugcgugaacggguccuguuuuaccauuaugacggauggaccgagcgacggccaggccucuuacaaaaucuuccgcauugaaaagggcaaaaucaucaagagcgucgagaugaaugcucccaacuaucauuacgaagagugcuccuguuacccugauucuagcgagauuacaugcguuugcagagacaauuggcacggguccaaccggcccugggugagcuuuaaucagaaccuggaauaucagaucggauacauuuguucuggcaucuucggggauaauccucgccccaacgacaaaaccggauccugcggcccggugagcucuaauggggccaacggagucaagggcuuuuccuucaaguauggcaacgggguguggauuggaagaacaaaaagcaucuccucucggaagggcuuugagaugauuugggauccuaauggguggaccggaaccgacaacagcuucuccaucaaacaagacaucguuggcauuaaugaauggucuggguacagcggcuccuucgugcagcaucccgagcuuacaggacuggauuguauccgcccuugcuuuugggucgaacucauuagaggccggcccaaggagaacacgaucuggaccagcgggucuuccauuagcuucuguggaguuaauucuggcacaguggggugguccuggcccgacggagcugagcugccuuuuaccaucgauaaauga

SEQ ID NO: 208958 - RNA, 1410 nt, Artificial Sequence
  derived and/or modified sequence opt5 from neuraminidase__InfluenzaA__AJJ99540
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcaaaaucacaugcguuugcagagacaauuggcacggguccaaccggcccugggugagcuucaaucagaaccuggaguaucagauuggauacaucuguucuggcauuuuuggggauaauccucgccccaacgacaagaccggauccugcggcccggugagcucuaauggggccaacggagucaagggcuucuccuuuaaauauggcaacgggaucuggauuggaagaacaaagagcaucuccucucggaaaggcuucgaaaugaucugggauccuaauggguggaccggaaccgacaacaauuuuagcauuaagcaagacaucgugggcauuaacgagugguccggguacucuggcagcuucguucagcaucccgaacuuacaggacuggauuguauccgcccuugcuucuggguggagcucauuagaggccggcccaaagaaaauacgaucuggaccuccgggagcucuaucuccuuuuguggagucaacagcgacacagugggcuggucuuggcccgauggggcugagcugccuuucaccauugacaaguga

SEQ ID NO: 208959 - RNA, 1410 nt, Artificial Sequence
  derived and/or modified sequence opt5 from neuraminidase__InfluenzaA__AJJ99551
augaaccccaaucagaagaucauuaccaucggcagcgugugcaugacaauugggauggccaaccugauccuccaaauuggaaauaucaucuccauuuggaucucucacagcauucagcugggcaaccagucccagacggagaccuguaaucaaucugucaucacauacgaaaacaauaccuggguuaaccagacauaugugaauauuagcaacaccaauccugcugccgggcaguccguggucucugugaaacuugcgggaaacagcucccugugcccgguuagcggcugggcuaucuacucuaaggacaauuccauuagaaucgggagcaaaggagauguguucgucauccgggagcccuuuauuucuuguuccagccucgaaugccgcacauucuuucugacccagggcgcccuucugaacgacaagcauucuaauggcacgaucaaagauagauccccuuaucggacccucaugagcugucccauuggggaggugccuucccccuacaacucucgcuucgaaagcguugccugguccgcuagcgccugccacgacggaaucaacuggcugacaauuggcaucucugggccugauaauggagcuguggccguccugaaguauaacggcaucauuaccgacacaaucaaguccuggagaaauaacauucuccggacccaagagagcgagugugcgugcgugaaugggucuuguuuuacgaucaugacagauggaccgagcgacggccaggccuccuacaaaauuuuccgcaucgaaaagggcaaaaucgugaagucugucgagaugaacgcucccaauuaucauuacgaagagugcagcuguuacccugauuccagcgagauuaccugcguuugcagagacaacuggcacgggucuaaucggcccuggguguccuuuaaccagaaucuggaauaucagaucggauacauuuguagcggcaucuucggggauaacccucgccccaaugacaaaacaggaucuugcggcccgguguccagcaacggggccaauggagucaagggcuuuuccuucaaguauggcaacgggguguggauuggaagaaccaaaucuaucagcucccggaagggcuuugagaugauuugggauccuaacggguggaccggaacagacaauaacuucucuaucaaacaagacaucguuggcauuaaugaauggagcggguacuccggcagcuuugugcagcaucccgagcuuacgggacuggauuguauccgcccuugcuucugggucgaacucauuagaggccggcccaaggagaacaccaucuggacaucuggguccagcauuucuuucuguggaguuaauuccgacaccgugggcuggagcuggcccgauggggcugagcugccuuuuacaaucgacaaauga

SEQ ID NO: 208960 - RNA, 1410 nt, Artificial Sequence; identical to SEQ ID NO: 203749
  derived and/or modified sequence opt5 from neuraminidase__InfluenzaA__AJJ99562

SEQ ID NO: 208961 - RNA, 1410 nt, Artificial Sequence
  derived and/or modified sequence opt5 from neuraminidase__InfluenzaA__AJJ99573
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacguugugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 208962 - RNA, 1410 nt, Artificial Sequence; identical to SEQ ID NO: 208939
  derived and/or modified sequence opt5 from neuraminidase__InfluenzaA__AJJ99584

SEQ ID NO: 208963 - RNA, 1410 nt, Artificial Sequence
  derived and/or modified sequence opt5 from neuraminidase__InfluenzaA__AJJ99595
augaaccccaaucagaagaucauuaccaucggcagcgugugcaugacaauugggauggccaaccugaucuuccaaauuggaaauaucaucuccauuuggaucucucacagcauucagcucggcaaccagaaucagaucgagacguguaaccaauccgucauuaccuacgaaaauaacacauggguuaaucagaccuaugugaacaucucuaauacaaacuuugcugccgggcagagcguggucuccgugaaacuggcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuucguccagcaucccgagcugacaggacuugauuguauccgcccuugcuuuuggguggaacugauuagaggccggcccaaagagaacacgaucuggaccuccgggagcucuauuuccuucuguggaguuaauagcgacacagugggcuggucuuggcccgauggggcugagcucccuuuuaccaucgacaaguga

SEQ ID NO: 208964 - RNA, 1410 nt, Artificial Sequence
  derived and/or modified sequence opt5 from neuraminidase__InfluenzaA__AJJ99606
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcgugauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 208965 - RNA, 1413 nt, Artificial Sequence; identical to SEQ ID NO: 200485
  derived and/or modified sequence opt5 from neuraminidase__InfluenzaA__AJJ99618

SEQ ID NO: 208966 - RNA, 1413 nt, Artificial Sequence
  derived and/or modified sequence opt5 from neuraminidase__InfluenzaA__AJJ99630
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccaugaaacagaacgugguugcgaucacagacuggagcggcuauuccggaucuuuugugcagcacccggaacucaccggccuggauugcauccggccuuguuucugggucgagcuugugcgcgggcugcccagagaaaauacaaccauuuggacgagcggauccucuaucagcuucugcggcguuaacuccgacacagccaauuggagcuggccugauggggcugagcuccccuuuaccauugacaaguga

SEQ ID NO: 208967 - RNA, 1413 nt, Artificial Sequence; identical to SEQ ID NO: 200485
  derived and/or modified sequence opt5 from neuraminidase__InfluenzaA__AJJ99642

SEQ ID NO: 208968 - RNA, 1413 nt, Artificial Sequence; identical to SEQ ID NO: 200485
  derived and/or modified sequence opt5 from neuraminidase__InfluenzaA__AJJ99654

SEQ ID NO: 208969 - RNA, 1413 nt, Artificial Sequence
  derived and/or modified sequence opt5 from neuraminidase__InfluenzaA__AJJ99666
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacaauaacguuguggccggagaagacaaaacaucugugacccuggcgggcaauagcucccuuuguagcauuucugggugggcuaucuacacaaaggauaacuccauucggaucggaagcaaaggcgacgucuucgugauucgcgagccuuuuaucucuugcucccaccuggaauguagaaccuucuuucucacgcaaggcgcccugcuuaaugauaagcauagcaacgggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaauuagcggcccugacaauggggcggucgccgugcugaaguauaacggaaucauuaccggcacaaucaaaucuuggaagaaacagauucucagaacccaggaguccgagugcguuuguaugaauggcagcugcuuuacgaucaugacagaugggcccucuaacaaggcugccagcuacaaaaucuucaagauugaaaagggaaaagugaccaaguccaucgagcugaaugcuccuaacuuucauuaugaagaguguucuugcuacccggacacaggcauugucaugugugugugccgggauaauuggcacgggagcaaccgccccuggguguccuucaaucagaaccuugacuaccaaaucggauauauuugcagcggcgucuuuggggauaauccuagacccgaggacggagaaggcucuuguaacccuguuaccguggauggcgccaauggggugaaaggauucuccuacaaguaugacaacggcgucuggaucgggcggaccaaaagcaaucgccugagaaagggauuugagaugauuugggaccccaacggcuggacaaacacggauucugacuucuccgugaaacaggauguuguggcgaucaccgacuggagcggguacuccggcucuuuuguccagcacccggaacucacaggacuggauugcauccggccuuguuucuggguggagcuuguucgcggccugcccagagaaaauaccacaauuuggaccagcggguccucuaucagcuucugcggagugaacuccgacacggccaauuggagcuggccugauggcgcugagcuccccuuuacaauugacaaguga

SEQ ID NO: 208970 - RNA, 1410 nt, Artificial Sequence
  derived and/or modified sequence opt5 from neuraminidase__InfluenzaA__AJJ99677
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauuaucaagagcguggagaugaaugcucccaacuaucauuacgaagagugcuccuguuacccugauucuagcgagauuacaugcgucugcagagacaauuggcacggguccaaccggcccuggguuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaagggcuucgagaugaucugggauccuaauggguggaccggaaccgacaacagcuuuuccauuaaacaagacaucgugggcaugaaugaauggucuggguacagcggcuccuucguucagcaucccgagcuuacaggacuggauuguauucgcccuugcuucuggguggaacucaucagaggccggcccaaggagaacacgauuuggaccagcgggucuuccaucagcuuuuguggagucaauucuggcacaguggggugguccuggcccgacggagcugagcugccuuucaccaucgauaaauga

SEQ ID NO: 208971 - RNA, 1410 nt, Artificial Sequence
  derived and/or modified sequence opt5 from neuraminidase__InfluenzaA__AJJ99688
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauuaucaagagcguggagaugaaugcucccaacuaucauuacgaagagugcuccuguuacccugauucuagcgagauuacaugcgucugcagagacaauuggcacggguccaaccggcccuggguuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaagggcuucgagaugaucugggauccuaauggguggaccggaaccgacaacagcuuuuccauuaaacaagacaucgugggcauuaaugaauggucuggguacagcggcuccuucguucagcaucccgagcuuacaggacuggauuguauccgcccuugcuucuggguggaacucauuagaggccggcccaaggagaacacgaucuggaccagcgggucuuccaucagcuuuuguggagucaauucuggcacaguggggugguccuggcccgacggagcugagcugccuuucaccauugauaaauga

SEQ ID NO: 208972 - RNA, 1410 nt, Artificial Sequence
  derived and/or modified sequence opt5 from neuraminidase__InfluenzaA__AJJ99710
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccaaaaucacaugcguuugcagagacaacuggcacgggagcaaucggcccugggugucuuucaaccagaaucuggaguaucagauuggauacaucuguuccggcauuuuuggggauaacccucgccccaaugacaagaccggaagcugcggcccggugucuuccaacggggccaauggagucaagggcuucagcuuuaaauauggcaacgggguguggaucggaagaacaaaguccauuucuagccggaaaggcuucgaaaugaucugggauccuaacggguggaccggaaccgacaauaacuuuuccaucaagcaagacauuguuggcaucaaugaguggucuggguacagcggcuccuucgugcagcaucccgaacuuacaggacuggauuguauucgcccuugcuucugggucgagcucaucagaggccggcccaaagaaaacacgauuuggaccagcgggucuuccaucagcuuuuguggaguuaauucugacacagugggcugguccuggcccgauggggcugagcugccuuucaccaucgacaaguga

SEQ ID NO: 208973 - RNA, 1410 nt, Artificial Sequence; identical to SEQ ID NO: 203281
  derived and/or modified sequence opt5 from neuraminidase__InfluenzaA__AJJ99721

SEQ ID NO: 208974 - RNA, 1410 nt, Artificial Sequence; identical to SEQ ID NO: 203281
  derived and/or modified sequence opt5 from neuraminidase__InfluenzaA__AJJ99732

SEQ ID NO: 208975 - RNA, 1410 nt, Artificial Sequence; identical to SEQ ID NO: 203981
  derived and/or modified sequence opt5 from neuraminidase__InfluenzaA__AJJ99743

SEQ ID NO: 208976 - RNA, 1410 nt, Artificial Sequence; identical to SEQ ID NO: 201315
  derived and/or modified sequence opt5 from neuraminidase__InfluenzaA__AJJ99754

SEQ ID NO: 208977 - RNA, 1410 nt, Artificial Sequence
  derived and/or modified sequence opt5 from neuraminidase__InfluenzaA__AJJ99765
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcuaccgggcagagcguggucuccgugaaacuugccggaaauucuagccugugcccuguuuccggcugggcgauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccuuaucggacccucaugucuugucccaucggggaggugccuucccccuacaacagccgcuuugaauccguugcuuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacggugaugacagauggaccgagcgacggccaggcgucuuacaaaauuuuucgcaucgaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguacucuggcagcuucguccagcaucccgagcuuacgggacuggauuguauccgcccuugcuucuggguggaacucauuagaggccggcccaaagagaacaccaucuggacauccgggagcucuauuuccuuuuguggaguuaauagcgacaccgugggcuggucuuggcccgauggggccgagcugccuuucacaaucgacaaguga

SEQ ID NO: 208978 - RNA, 1413 nt, Artificial Sequence
  derived and/or modified sequence opt5 from neuraminidase__InfluenzaA__AJJ99777
augaaccccaaucagaagaucauuaccaucggcagcauuuccaucgccauugggaucaucucucugauucuccaaaucggaaacauuaucagcauuugggcuucccacucuauccagacaggcagccagaauaacacggggauuugcaaucagagaaucaucaccuacgagaacuccacaugggugaaucauaccuaugucaacauuaauaacacaaauguuguggccggagaagacaaaaccucugugacacuggcgggcaacagcucccuuuguagcaucucugggugggcuauuuacaccaaggauaauuccauccggauuggaagcaaaggcgacgucuucgugauccgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccauuggaaucagcggcccugacaacggggcggucgccgugcugaaguauaauggaauuaucacaggcaccauuaaaucuuggaagaaacagauccucagaacgcaggaguccgagugcguuuguaugaacggcagcugcuuuacaaucaugaccgaugggcccucuaauaaggcugccagcuacaaaauuuucaagaucgaaaagggaaaagugacaaaguccauugagcugaacgcuccuaauuuuuauuacgaagaguguucuugcuacccggacaccggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuaccguggauggcgccaacggggugaaaggauucuccuauaaguacggcaauggggucuggauuggacggacaaaaagcaaccgccugagaaagggcuuugagaugaucugggaccccaauggguggacgaacaccgacucugauuucuccgugaaacaggacguuguggcgaucacagauuggagcggcuauuccggaucuuuuguccagcacccggaacucaccggccuggacugcauucggccuuguuucuggguggagcuuguucgcgggcugcccagagaaaacacagccguguggaccagcggauccucuaucagcuucugcggcgucaauuccgauacggcuaacuggagcuggccugacggggccgagcuccccuuuacaauugauaaguga

SEQ ID NO: 208979 - RNA, 1410 nt, Artificial Sequence; identical to SEQ ID NO: 199762
  derived and/or modified sequence opt5 from neuraminidase__InfluenzaA__AJJ99788

SEQ ID NO: 208980 - RNA, 1413 nt, Artificial Sequence
  derived and/or modified sequence opt5 from neuraminidase__InfluenzaA__AJJ99800
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccagagaaaacacaaccauuuggacgagcggauccucuaucagcuucugcggcgucaauuccgauacagccaacuggagcuggccugacggggcugagcuccccuuuauuaucgauaaguga

SEQ ID NO: 208981 - RNA, 1413 nt, Artificial Sequence; identical to SEQ ID NO: 200485
  derived and/or modified sequence opt5 from neuraminidase__InfluenzaA__AJJ99812

SEQ ID NO: 208982 - RNA, 1413 nt, Artificial Sequence
  derived and/or modified sequence opt5 from neuraminidase__InfluenzaA__AJJ99824
augaaccccaaucagaagaucauuaccaucggcagcauuuccaucgccauugggacaaucucucugaugcuccaaaucggaaacauuaucagcauuugggcuucccacucuauccagacgggcagccagaauaacaccgggauuugcaaucagagaaucauuacauacgagaacuccaccugggugaaucauacauaugugaacaucaauaacaccaauguuguggccggagaagacaaaacaucugugacccuggcgggcaacagcucccuuuguagcaucucugggugggcuauuuacacgaaggauaauuccauccggauuggaagcaaaggcgacgucuucgugauccgcgagccuuuuauuucuugcucccaccuggaauguagaaccuucuuucucacacaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaaucagcggcccugacaacggggcggucgccgugcugaaguauaauggaauuaucaccggcacgauuaaaucuuggaagaaacagauccucagaacacaggaguccgagugcguuuguaugaacggcagcugcuuuaccauuaugacagaugggcccucuaauaaggcugccagcuacaaaaucuucaagaucgaaaagggaaaagugaccaaguccauugagcugaacgcuccuaauuuucauuaugaagaguguucuugcuacccggacaccggcaucgucaugugugugugccgggauaacuggcacgggagcaaucgccccuggguguccuucaaccagaaucuugacuaccaaauuggauauaucugcagcggcgucuuuggggauaacccuagacccgaggacggagaaggcucuuguaauccuguuacaguggauggcgccaacggggugaaaggauucuccuacaaguaugacaauggcgucuggauugggcggacgaaaagcaaccgccugagaaagggauuugagaugaucugggaccccaauggcuggaccaacacagauucugacuucuccgugaaacaggauguuguggcgauuaccgacuggagcggguacuccggcucuuuuguccagcacccggaacucacaggacuggauugcauccggccuuguuucuggguggagcuuguucgcggccugcccagagaaaacaccacgaucuggacaagcggguccucuauuagcuucugcggagucaauuccgacaccgccaacuggagcuggccugauggcgcugagcuccccuuuaccaucgacaaguga

SEQ ID NO: 208983 - RNA, 1410 nt, Artificial Sequence; identical to SEQ ID NO: 208971
  derived and/or modified sequence opt5 from neuraminidase__InfluenzaA__AJJ99835

SEQ ID NO: 208984 - RNA, 1410 nt, Artificial Sequence; identical to SEQ ID NO: 203281
  derived and/or modified sequence opt5 from neuraminidase__InfluenzaA__AJJ99846

SEQ ID NO: 208985 - RNA, 1410 nt, Artificial Sequence; identical to SEQ ID NO: 203281
  derived and/or modified sequence opt5 from neuraminidase__InfluenzaA__AJJ99857

SEQ ID NO: 208986 - RNA, 1410 nt, Artificial Sequence
  derived and/or modified sequence opt5 from neuraminidase__InfluenzaA__AJJ99868
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgugauuacaugcgugugcagagacaauuggcacggguccaaccggcccugggucagcuucaaucagaaccuggaguaucagaucggauacauuuguucuggcaucuuuggggauaauccucgccccaacgacaaaaccggauccugcggcccggugagcucuaauggggccaacggaguuaagggcuucuccuuuaaguauggcaacgggguguggauuggaagaacaaaaagcaucuccucucggaauggcuucgaaaugauuugggauccuaacggguggaccggaaccgacaauaacuuuagcaucaagcaaaauaucgucggcauuaacgagugguccggguacucuggcagcuucgugcagcaucccgaacuuacaggacuggacuguauccgcccuugcuucuggguugagcucauuagaggccggcccaaagaaaauacgaucuggaccuccgggagcucuauuuccuuuuguggagugaacagcgauacagucggcuggucuuggcccgacggggcugagcugccuuucaccaucgauaaguga

SEQ ID NO: 208987 - RNA, 1410 nt, Artificial Sequence; identical to SEQ ID NO: 202181
  derived and/or modified sequence opt5 from neuraminidase__InfluenzaA__AJJ99879

SEQ ID NO: 208988 - RNA, 1410 nt, Artificial Sequence; identical to SEQ ID NO: 199762
  derived and/or modified sequence opt5 from neuraminidase__InfluenzaA__AJJ99890

SEQ ID NO: 208989 - RNA, 1410 nt, Artificial Sequence
  derived and/or modified sequence opt5 from neuraminidase__InfluenzaA__AJJ99901
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacagcuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggaguggacucuggcacaguugggugguccuggcccgauggagcugagcugccuuucaccaucgacaaauga

SEQ ID NO: 208990 - RNA, 1410 nt, Artificial Sequence
  derived and/or modified sequence opt5 from neuraminidase__InfluenzaA__AJJ99912
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccaaaaucacaugcguuugcagagacaacuggcacgggagcaaucggcccugggugucuuucaaccagaaucuggaguaucagauuggauacaucuguuccggcauuuuuggggauaacccucgccccaaggacaagaccggaagcugcggcccggugucuuccaauggggccaacggagucaaaggcuucagcuuuaaguauggcaaugggguguggaucggaagaacaaaauccauuucuagccggaagggcuucgaaaugaucugggauccuaacggguggaccggaaccgacaacaauuuuuccaucaaacaagacauuguuggcaucaacgaguggucuggguacagcggcuccuucgugcagcaucccgaacuuacaggacuggauuguauucgcccuugcuucugggucgagcucaucagaggccggcccaaggaaaauacgauuuggaccagcgggucuuccaucagcuuuuguggagugaacucugacacaguuggcugguccuggcccgauggggcugagcugccuuucaccaucgacaaauga

SEQ ID NO: 208991 - RNA, 1410 nt, Artificial Sequence; identical to SEQ ID NO: 203281
  derived and/or modified sequence opt5 from neuraminidase__InfluenzaA__AJJ99923

SEQ ID NO: 208992 - RNA, 1410 nt, Artificial Sequence; identical to SEQ ID NO: 203733
  derived and/or modified sequence opt5 from neuraminidase__InfluenzaA__AJJ99934

SEQ ID NO: 208993 - RNA, 1410 nt, Artificial Sequence; identical to SEQ ID NO: 203281
  derived and/or modified sequence opt5 from neuraminidase__InfluenzaA__AJJ99945

SEQ ID NO: 208994 - RNA, 1410 nt, Artificial Sequence
  derived and/or modified sequence opt5 from neuraminidase__InfluenzaA__AJJ99956
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccgguccuuagcaauggggccaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcugacaggacucgauuguauccgcccuugcuucuggguggaacugauuagaggccggcccaaagagaacacgaucuggaccagcggguccagcauuucuuuuuguggaguuaauuccgacacagugggcuggagcuggcccgauggggcugagcuuccuuucaccaucgacaaguga

SEQ ID NO: 208995 - RNA, 1410 nt, Artificial Sequence; identical to SEQ ID NO: 199762
  derived and/or modified sequence opt5 from neuraminidase__InfluenzaA__AJJ99967

SEQ ID NO: 208996 - RNA, 1413 nt, Artificial Sequence
  derived and/or modified sequence opt5 from neuraminidase__InfluenzaA__AJJ99991
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuguacaugggugaaucauaccuaugucaacaucaauaacacaaauguuguggccggagaagacaaaaccuccgugacacuggcgggcaacucuagccuuugcuccauuagcgggugggcuaucuacaccaaggauaauucuauucggaucggauccaaaggcgacgucuucgugauucgcgagccuuuuaucagcuguucucaccuggaaugcagaacguucuuucucacccaaggcgcccugcuuaacgauaagcauuccaaugggacaguuaaagaccggagcccguaucgcgcccugaugucuuguccccucggagaggcuccuucccccuacaacagcaaguucgaauccguggccuggucugcuagcgccugccacgauggcaugggguggcugaccaucggaauuuccggcccugacaacggggcggucgccgugcugaaguauaauggaaucauuacaggcaccaucaaaagcuggaagaaacagauucucagaacgcaggagucugaguguguuugcaugaacggcuccuguuuuacaaucaugaccgaugggcccagcaauaaggcugccucuuacaaaaucuucaagauugaaaagggaaaagugacaaagagcaucgagcugaacgcuccuaauuuucauuaugaagagugcuccuguuacccggacaccggcauugucaugugcgugugccgggauaacuggcacgggucuaaucgccccugggugagcuucaaccagaaucuugacuaccaaaucggauauauuuguuccggcgucuuuggggauaacccuagacccgaggacggagaaggcagcugcaauccuguuaccguggauggcgccaacggggugaaaggauucucuuacaaguaugacaauggcgucuggaucgggcggacaaaauccaaccgccugagaaagggauuugagaugauuugggaccccaauggcuggacgaacaccgauagcgacuucucugugaaacaggauguuguggcgaucacagacugguccggguacagcggcuccuuuguccagcacccggaacucaccggacuggauuguauccggccuugcuucuggguggagcuuguucgcggccugcccagagaaaacacaaccauuuggacgucugggagcuccaucucuuucuguggagugaauagcgacacagccaacugguccuggccugauggcgcugagcuccccuuuaccauugacaaguga

SEQ ID NO: 208997 - RNA, 1410 nt, Artificial Sequence; identical to SEQ ID NO: 208971
  derived and/or modified sequence opt5 from neuraminidase__InfluenzaA__AJK00003

SEQ ID NO: 208998 - RNA, 1410 nt, Artificial Sequence
  derived and/or modified sequence opt5 from neuraminidase__InfluenzaA__AJK00014
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcgugauuacagacaccaucaagucuuggagaaauaacauucuccggacacaagaguccgagugugcgugcgugaaugggagcuguuucaccaucaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaagggcuucgagaugauuugggauccuaacggguggaccggaaccgacaauaacuuuuccacaaaacaagacaucgugggcaucaaugaauggucuggguacagcggcuccuucguccagcaucccgagcuuacgggacuggauuguauucgcccuugcuucuggguggaacucaucagaggccggcccaaggagaacaccauuuggacaagcgggucuaucauuuccuuuuguggaguuaauagcgacaccgugggcuggucuuggcccgauggggcugagcugccuuucacaaucgacaacuga

SEQ ID NO: 208999 - RNA, 1410 nt, Artificial Sequence
  derived and/or modified sequence opt5 from neuraminidase__InfluenzaA__AJK00025
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugugaagucugucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacagcuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggagugaauagcggcacaguugggugguccuggcccgacggagcugagcugccuuucaccaucgauaaauga

SEQ ID NO: 209000 - RNA, 1410 nt, Artificial Sequence
  derived and/or modified sequence opt5 from neuraminidase__InfluenzaA__AJK00036
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacauuaauuucgcugccgggcaguccguggucucugugaaacuugcgggaaacagcucccugugcccuguuagcggcugggcuaucuacucuaaggacaauuccaucagaauugggagcaaaggagauguguuugucauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggaggugccuagccccuacaacucccgcuuugaaucuguugccuggagcgcuuccgccugccacgacggaaucaacuggcugacgaucggcauuagcgggccugauaauggagcuguggccguccugaaguauaacggcaucauuaccgacacaaucaagucuuggagaaauaacauucuccggacccaagaguccgagugugcgugcgugaaugggagcuguuucacaaucaugaccgauggaccgucugacggccaggccagcuacaaaaucuuucgcauugaaaagggcaaaaucgugaaguccgucgagaugaacgcucccaauuaucauuacgaagagugcucuuguuacccugauagcuccgagauuacgugcguuugcagagacaacuggcacgggagcaaucggcccugggugucuuucaaccagaaucuggaauaucagaucggauacauuuguuccggcaucuuuggggauaacccucgccccaaugacaaaacaggaagcugcggcccggugucuuccaacggggccaauggagucaagggcuucagcuuuaaguauggcaacgggguguggauuggaagaaccaaauccaucucuagccggaagggcuucgagaugaucugggauccuaacggguggacaggaaccgacaauaacuuuuccauuaaacaagacaucguuggcauuaaugaauggucuggguacagcggcuccuucgugcagcaucccgagcuuaccggacuggauuguauccgcccuugcuucugggucgaacucauuagaggccggcccaaggagaacacaaucuggacgagcgggucuuccaucagcuuuuguggaguuaauucugacaccgugggcugguccuggcccgauggggcugagcugccuuucacaauugacaaauga

SEQ ID NO: 209001 - RNA, 1410 nt, Artificial Sequence; identical to SEQ ID NO: 203981
  derived and/or modified sequence opt5 from neuraminidase__InfluenzaA__AJK00047

SEQ ID NO: 209002 - RNA, 1410 nt, Artificial Sequence; identical to SEQ ID NO: 203981
  derived and/or modified sequence opt5 from neuraminidase__InfluenzaA__AJK00058

SEQ ID NO: 209003 - RNA, 1410 nt, Artificial Sequence
  derived and/or modified sequence opt5 from neuraminidase__InfluenzaA__AJK00069
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuauuucaacaucucuaauacaaacuuugcugccgggcagagcgugguguccgucaaacuugcgggaaauucuagccugugcccuguguccggcugggcuauuuacagcaaggacaacucuaucagaaucggguccaaaggagauguuuucgugauucgggagccguuuaucagcuguucuccccucgaaugccgcaccuucuuucugacacagggcgcccuucugaaugacaagcauuccaacggcaccauuaaagauagaagcccuuaucggacgcucaugucuugucccaucggggaggucccuucccccuacaacagccgcuucgaauccguggccuggucugcuagcgccugccacgacggaauuaauuggcugaccaucggcaucuccgggccugauaacggagcuguugccgugcugaaguauaauggcauuaucacagacaccauuaagagcuggagaaacaauauccuccggacacaagagucugagugugcgugcgucaacggguccuguuuuaccgugaugacggauggaccgagcgacggccaggccucuuacaaaauuuuccgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuuuaaucagaaccuggaauaucagaucggauacauuuguucuggcaucuucggggauaauccucgccccaacgacaaaaccggauccugcggcccggugagcucuaauggggccaacggagucaagggcuuuuccuucaaguauggcaacgggguguggauuggaagaacaaaaagcaucuccucucggaauggcuuugagaugauuugggauccuaacggguggaccggaaccgacaauaacuucagcaucaagcaagacaucguuggcauuaaugaaugguccggguacucuggcagcuucgugcagcaucccgagcuuacaggacuggauuguauccgcccuugcuuuugggucgaacucauuagaggccggcccaaagagaacacgaucuggaccuccgggagcucuauuuccuucuguggagugaauagcgacacaguuggcuggucuuggcccgauggggcugagcugccuuuuaccaucgacaaguga

SEQ ID NO: 209004 - RNA, 1413 nt, Artificial Sequence; identical to SEQ ID NO: 200485
  derived and/or modified sequence opt5 from neuraminidase__InfluenzaA__AJK00081

SEQ ID NO: 209005 - RNA, 1413 nt, Artificial Sequence; identical to SEQ ID NO: 199656
  derived and/or modified sequence opt5 from neuraminidase__InfluenzaA__AJK00093

SEQ ID NO: 209006 - RNA, 1413 nt, Artificial Sequence
  derived and/or modified sequence opt5 from neuraminidase__InfluenzaA__AJK00105
augagccccaaccagaagaucauuaccaucggcuccauuucuaucgccauugggaucaucagccugaugcuccaaauuggaaauacaaucuccauuugggcuucucacagcauccagacgggcucccagaacaauaccgggauuugcaaccagagaaucauuacauacgaaaauucuaccugggugaaccauacauaugucaauaucaacaauaccaacguuguggccggagaggacaaaacaagcgugacccuggcgggcaauuccagccuuuguucuaucuccgggugggcuauuuacacgaaggauaacagcauccggauuggaucuaaaggcgacgucuucgugauccgcgagccuuuuauuuccugcagccaccuggaauguagaaccuucuuucucacacaaggcgcccugcuuaaugauaagcauucuaacgggaccguuaaagaccgguccccguaucgcgcccugaugagcugcccccucggagaggcuccuucccccuacaauucuaaguucgaaagcguggccugguccgcuagcgccugucacgauggcaugggguggcugacaaucggaaucucuggcccugacaacggggcggucgccgugcugaaguauaacggaauuaucaccggcacgauuaaauccuggaagaaacagauccucagaacacaggagagcgagugcguuuguaugaauggcucuugcuuuaccauuaugacagaugggcccagcaacaaggcugccuccuacaaaaucuucaagaucgaaaagggaaaagugaccaagucuauugagcugaaugcuccuaacuuucauuaugaagaguguagcugcuacccggacaccggcaucgucaugugugugugccgggauaauuggcacggguccaaccgccccugggugagcuucaaucagaaccuugacuaccaaauuggauauaucugcucuggcgucuuuggggauaauccuagacccgaggacggagaaggcuccuguaacccuguuacaguggauggcgccaauggggugaaaggauucagcuacaaguaugacaacggcgucuggauugggcggacgaaaucuaaucgccugagaaagggauuugagaugaucugggaccccaacggcuggaccaauacagauuccgacuucagcgugaaacaggauguuguggcgauuaccgacugguccggguacucuggcagcuuuguccagcacccggaacucacaggacuggauugcauccggccuuguuucuggguggagcuuguucgcggccugcccagagaaaacaccacgaucuggacauccgggucuagcauuuccuucugcggagugaacagcgacaccgccaauuggucuuggccugauggcgcugagcuccccuuuaccaucgacaaguga

SEQ ID NO: 209007 - RNA, 1410 nt, Artificial Sequence; identical to SEQ ID NO: 202037
  derived and/or modified sequence opt5 from neuraminidase__InfluenzaA__AJK00116

SEQ ID NO: 209008 - RNA, 1410 nt, Artificial Sequence; identical to SEQ ID NO: 200869
  derived and/or modified sequence opt5 from neuraminidase__InfluenzaA__AJK00127

SEQ ID NO: 209009 - RNA, 1410 nt, Artificial Sequence; identical to SEQ ID NO: 199762
  derived and/or modified sequence opt5 from neuraminidase__InfluenzaA__AJK00138

SEQ ID NO: 209010 - RNA, 1350 nt, Artificial Sequence
  derived and/or modified sequence opt5 from neuraminidase__InfluenzaA__AJK00152
augaaccccaaucagaagaucauuaccaucggcagcauuugcauggugacagggaucgucucccugaugcuccaaauuggaaacaucaucucuauguggguuagccacuccauucagacgagaaaucagcaucagaccgagccuauccggaacacaaauuuccugaccgaaaacgccguggcuucugugacacuugccggcaauagcucccuguguccgauucgcgggugggcgguccacucuaaagacaacagcaucagaauuggauccaagggcgauguguuuguuauccgggagcccuucauuagcugcucucaucucgaaugucgcaccuuuuuccugacacaaggggcucuuaucaaugacaaacacuccaacggaaccgugaaggauagaagcccucaucggacgcugaugucuugccccgucggcgaggccccuucccccuacaauagccgcuuugaaucuguggccugguccgcuagcgccugucacgacggcaccuccuggcucacaaucgggauuucuggaccugauaacggcgcuguugccgugcugaaauauaaugggaucauuaccgacacaaucaagagcuggagaaacaauauucugcggacccaggaguccgagugcgcgugugucaacggaagcugcuucacggugaugacagauggcccgucuaacgggcaggccuccuacaagaucuuuaaaauggaaaagggaaaaguggucaagagcguugagcucaaugcucccaacuaucacuacgaagaguguucuugcuauccugacgccggcgagaucaccugugugugccgcgauaauuggcauggcagcaacagacccuggguguccuucaaucagaaccuggaauaccaaauuggguauaucugcucuggagucuuuggcgacaauccucggcccaacgaugggacaggaagcuguggcccgguguccccuaauggggcuuacggaauuaaaggcuucagcuuuaaguacggcaacgggguuuggaucggacgcaccaagucuaccaauuccagaagcggcuucgagaugauuugggaccccaacggguggacaggaacggauucugacuuuuccgugaaacaggacaucgucgaaaucaccgauuggagcggcuauuccgggucuuucgugcagcacccugagcuuacaggccuggacugcauucggcccuguuucuggguugaacucauccgcggaagacccaaggagagcaccauuuggacauccggcucuagcaucuccuuuugcggggugaauagcgauaccgucucuugguccuggccugacggagccgagcugccguucacgauugauaaauga

SEQ ID NO: 209011 - RNA, 1350 nt, Artificial Sequence
  derived and/or modified sequence opt5 from neuraminidase__InfluenzaA__AJK00167
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacgcuaauuuccugacggaaaacgccguggcgucugugacccuugcugggaauagcucccuguguccgguccggggaugggccgugcacucuaaagacaacagcauccgcauuggcuccaagggggauguuuuugugaucagagagcccuucauuagcugcucucaucucgaaugucggacauuuuuccugacccaaggagcccuucugaaugacaaacacuccaacggcacagucaaggaucgcagcccucauagaacccucaugucuugccccgugggcgaggcuccuucccccuacaauagccgguuugaaucuguugccugguccgcuagcgccugucacgacgggacauccuggcugaccaucggaaucucuggcccugauaacggggcgguggccguccugaaauauaauggaauuaucacggacaccauuaagagcuggcgcaacaauauccucagaacacaggaguccgagugcgcuugugugaacggcagcugcuucaccgugaugacagaugggccgucuaacggacaggccuccuacaagauuuuuaaaauggaaaagggcaaagucguuaagagcguggagcugaaugcucccaacuaucacuacgaagaguguucuugcuauccugacgccggcgagaucaccugugugugccgggauaauuggcaugggagcaaccgccccugggucuccuucaaucagaaccuugaauaccaaaucggauauauuugcucuggcguguuuggggacaauccuagacccaacgauggaacgggcagcugugggccgguuuccccuaauggagcguacggcaucaaaggcuucagcuuuaaguacgggaacggaguguggauuggccggacaaagucuaccaauucccgcagcggguucgagaugaucugggaccccaacggauggacagaaaccgauucuaauuuuuccgucaaacaggacauuguggccaucaccgacuggagcggcuauuccgggucuuucguucagcacccugagcugacaggccucgauugcaucagacccuguuucuggguggaacugauucggggacgccccaaggagagcacgaucuggaccuccggcucuagcauuuccuuuugcggggucaacagcgacacagugucuugguccuggccugauggagcugagcuuccguucaccaucgacaaauga

SEQ ID NO: 209012 - RNA, 1350 nt, Artificial Sequence
  derived and/or modified sequence opt5 from neuraminidase__InfluenzaA__AJK00178
augaaccccaaucagaagaucauuaccaucggcagcauuugcauggugaucgggauugucucccugaugcuccaaaucggaaacaugaucucuauuugggccagccacuccaucagaacaggcaaucagaaccagguugagccuauuaucaauacgaacuucccgaccgaaaaagcugccgcgucuauuacacuggcugggaauagcucccuuugucccauccggggaugggccauucauucuaaggacaacagcauccgcaucggcuccaaaggggauguguuugugauuagagagccuuucaucagcugcucucaccuggaaugucggaccuuuuuccucacacagggagcccugcuuaaugacaagcauuccaacggcaccgucaaagaucgcagcccccacagaacacugaugucuugcccugugggcgaggcucccuccccuuacaauagccgguuugaaucuguugccugguccgcuagcgccugucaugacgggaccuccuggcucacgauuggaaucucuggcccggauaacggggcgguggccguccugaaguauaauggaauuaucaccgacacaaucaagaccuggcgcaacaauauucugagaacacaagagagcgagugcgcuugugugaacggcuccugcuucaccguuaugacggaugggcccagcgacggacaggccucuuacaaaaucuuuaagauggaaaaaggcaaggugauuaaauccgucgagcucgaugcuccuaacuaucacuacgaagaguguagcugcuaucccgacgccggcgagaucacaugugugugccgggauaauuggcacgggucuaaccgcccuugggugagcuucaaucagaaccuggaauaccagauuggauauaucugcuccggcgucuuuggggacaaucccagaccgaccgauggaacaggcucuugugggccuguuagccauaacggagcguacggcgugaagggcuucuccuuuaaguacgggaauggaguguggaucggccggaccaaaagccccaacucucgcuccggguucgagaugauuugggacccuaauggauggagcgaaaccgacucuuccuuuagcgucaagcaagauaucguggccauuacagacugguccggcuauucugggagcuucguucagcaccccgagcuuacgggccuggauugcaucagacccuguuucuggguggaacucauucggggacgcccuaaagaguccaccgucuggacaucuggcagcuccaucagcuuuugcggggugaacucugacaccguuuccuggagcuggccggauggagcugagcugcccuucacaauugacaaguga

SEQ ID NO: 209013 - RNA, 1350 nt, Artificial Sequence
  derived and/or modified sequence opt5 from neuraminidase__InfluenzaA__AJK00199
augaaccccaaucagaagaucauuaccaucggcagcauuugcauggugaucgggauugucucccugaugcuccaaaucggaaacaugaucucuauuuggguuagccacuccauccagacaggcaaucagaaccagguggagccuauuaucaauacgaacuuccugaccgaaaaagccguggucucuauuacacuugcugggaauagcucccuguguccgaucagaggaugggccauucauucuaaggacaacagcauccggaucggcuccaaaggggauguguuuguuauucgcgagcccuucaucagcugcucucaccucgaauguagaaccuuuuuccugacacaaggagcgcuucugaaugacaagcauuccaacggcaccgugaaagaucggagcccucaccgcacacucaugucuugccccgucggcgaggcuccuucccccuacaauagcagauuugaaucuguggccugguccgccagcgcuugucaugacgggaccuccuggcugacgauuggaaucucuggcccugauaacggggccgcugccguucugaaguauaauggaauuaucaccgacacaaucaagagcuggcggaacaauauucuccgcacccaggaguccgagugcgcgugugugaacggcagcugcuucacagucaugaccgaugggccgucugacggacaggccuccuacaaaaucuuuaagauggaaaaaggcaaggugauuaaaagcguggagcuggaugcucccaacuaucacuacgaagaguguucuugcuauccugacgccggcgagaucacgugugucugcagagauaauuggcacgggagcaaccggcccuggguuuccuucaaucagaaccuugaauaccaaauuggauauaucugcucuggcguguuuggggacaauccucgccccaacgauggaacaggcagcuguuccccggugagccauaauggggcuuacggagucaagggcuucucuuuuaaguacggcaacgggguguggaucggaagaaccaaauccccuaauagccggucuggcuucgagaugauuugggaccccaacgggugguccgaaacagacagcuccuuuucuguuaagcaggauaucguggccauuaccgacuggagcggauauuccggcucuuucguccagcacccugagcugaccgggcucgauugcauccgccccuguuucuggguggaacugauuagaggccggcccaaagagagcacaguuuggacguccggaagcucuaucuccuuuugcggcgugaauagcgacaccgucucuugguccuggccugauggggcggagcuuccguucacaauugacaaguga

SEQ ID NO: 209014 - RNA, 1350 nt, Artificial Sequence
  derived and/or modified sequence opt5 from neuraminidase__InfluenzaA__AJK00208
augaaccccaaucagaagaucauuaccaucggcagcauuugcauggugacagggaucgucucccugaugcuccaaauuggaaacaucaucucuauguggguuagccacuccauucagacgagaaaucagcaucagaccgagccuauccggaacacaaauuuccugaccgaaaacgccguggcuucugugacacuugccggcaauagcucccuguguccgauucgcgggugggcgguccacucuaaagacaacagcaucagaauuggauccaagggcgauguguuuguuauccgggagcccuucauuagcugcucucaucucgaaugucgcaccuuuuuccugacacaaggggcccuucugaaugacaaacacuccaacggaaccgugaaggauagaagcccucaucggacgcucaugucuugccccgucggcgaggcuccuucccccuacaauagccgcuuugaaucuguggccugguccgcuagcgccugucacgacggcaccuccuggcugacaaucgggaucucuggaccugauaacggcgcuguugccgugcugaaauauaaugggauuaucaccgacacaauuaagagcuggagaaacaauauccuccggacccaggaguccgagugcgcgugugucaacggaagcugcuucacggugaugacagauggcccgucuaacgggcaggccuccuacaagauuuuuaaaauggaaaagggaaaaguggucaagagcguugagcugaaugcucccaacuaucacuacgaagaguguucuugcuauccugacgccggcgagaucaucugugugugccgcgauaauuggcauggcagcaacagacccuggguguccuucaaucagaaccuugaauaccaaauuggguauaucugcucuggagucuuuggcgacaauccucggcccaacgaugggaccggaagcuguggcccgguguccccuaauggggcuuacggaauuaaaggcuucagcuuuaaguacggcaacgggguuuggaucggacgcacaaagucuaccaauuccagaagcggcuucgagaugauuugggaccccaacggguggaccggaacagauucugacuuuuccgugaaacaggacaucgucgaaaucacggauuggagcggcuauuccgggucuuucgugcagcacccugagcugaccggccucgacugcauucggcccuguuucuggguugaacugauccgcggaagacccaaggagagcacaauuuggaccuccggcucuagcaucuccuuuugcggggugaauagcgauacagucucuugguccuggccugacggagccgagcuuccguucaccauugauaaauga

SEQ ID NO: 209015 - RNA, 1350 nt, Artificial Sequence
  derived and/or modified sequence opt5 from neuraminidase__InfluenzaA__AJK00219
augaaccccaaucagaagaucauuaccaucggcagcauuugcauggugacagggaucgucucccugaugcuccaaauuggaaacaucaucucuauguggguuagccacuccauucagacgagaaaucagcaucaggccgagccuauccggaacaccaauuuccugacagaaaacgcuguggccucugugacccuugcgggcaaucugagccucuguccgauucgcgggugggcuguccacuccaaagacaacaauaucagaauuggaucuaagggcgauguguuuguuauccgggagcccuucauuagcugcucccaucuggaaugucgcacauuuuuccuuacccaaggggcccugcucaacgacaaacacagcaauggaacagugaaggauagaucuccucaucggacccugauguccugccccgucggcgaggccccuagccccuacaacucucgcuuugaauccguggcuuggagcgccucugcuugucacgacggcacguccuggcugaccaucgggaucagcggaccugauaauggcgccguugcggugcucaaauauaacgggauuaucacagacaccauuaaguccuggagaaauaacauccugcggacacaggagucugagugcgccugugucaacggaagcugcuucaccgugaugacggauggcccguccaaugggcaggcuagcuacaagauuuuuaaaauggaaaagggaaaaguggucaagucuguugagcuuaacgcccccaauuaucacuacgaagaguguuccugcuauccugacgcuggcgagaucaucugugugugccgcgauaacuggcauggcagcaauagacccugggugucuuucaaccagaaucuggaauaccaaauuggguauaucugcagcggagucuuuggcgacaacccucggcccaaugaugggacaggauccuguggcccggugucuccuaacggggccuacggaauuaaaggcuucagcuuuaaguacggcaaugggguuuggaucggacgcaccaaguccacaaacagcagaucuggcuucgagaugauuugggaccccaauggguggaccggaaccgauuccgacuuuagcgugaaacaggacaucgucgaaaucacagauuggucuggcuauuccgggagcuucgugcagcacccugagcucacgggccuggacugcauucggcccuguuucuggguugaacuuauccgcggaagacccaaggaguccaccauuuggacaucuggcagcuccaucucuuuuugcggggugaacagcgauaccgucuccuggagcuggccugacggagcggagcugccguucacaauugauaaauga

SEQ ID NO: 209016 - RNA, 1350 nt, Artificial Sequence
  derived and/or modified sequence opt5 from neuraminidase__InfluenzaA__AJK00230
augaaccccaaucagaagaucauuaccaucggcagcauuugcauggugacagggaucgucucccugaugcuccaaauuggaaacaucaucucuauguggguuagccacuccauucagacgagaaaucagcaucagaccgagccuauccggaacacaaauuuccugaccgaaaacgccguggcuucugugacacuugccggcaauagcucccuguguccgauucgcgggugggcgguccacucuaaagacaacagcaucagaauuggauccaagggcgauguguuuguuauccgggagcccuucauuagcugcucucaucucgaaugucgcaccuuuuuccugacacaaggggcucuuaucaaugacaaacacuccaacggaaccgugaaggauagaagcccucaucggacgcugaugucuugccccgucggcgaggccccuucccccuacaauagccgcuuugaaucuguggccugguccgcuagcgccugucacgacggcaccuccuggcucacaaucgggauuucuggaccugauaacggcgcuguugccgugcugaaauauaaugggaucauuaccgacacaaucaagagcuggagaaacaauauucugcggacccaggaguccgagugcgcgugugucaacggaagcugcuucacggugaugacagauggcccgucuaacgggcaggccuccuacaagaucuuuaaaauggaaaagggaaaaguggucaagagcguugagcucaaugcucccaacuaucacuacgaagaguguucuugcuauccugacgccggcgagaucauuugugugugccgcgauaauuggcauggcagcaacagacccuggguguccuucaaucagaaccuggaauaccaaaucggguauauuugcucuggagucuuuggcgacaauccucggcccaacgaugggaccggaagcuguggcccgguguccccuaauggggcuuacggaaucaaaggcuucagcuuuaaguacggcaacgggguuuggauuggacgcacaaagucuaccaauuccagaagcggcuucgagaugaucugggaccccaacggguggaccggaacagauucugacuuuuccgugaaacaggacaucgucgaaauuacggauuggagcggcuauuccgggucuuucgugcagcacccugagcuuaccggccuggacugcauccggcccuguuucuggguugaacucauucgcggaagacccaaggagagcacaaucuggaccuccggcucuagcauuuccuuuugcggggugaauagcgauacagucucuugguccuggccugacggagccgagcugccguucaccaucgauaaauga

SEQ ID NO: 209017 - RNA, 1380 nt, Artificial Sequence
  derived and/or modified sequence opt5 from neuraminidase__InfluenzaA__AJS18470
augaaccccaaucagaagauuaccugcaucagcgccacaggcgugacgcuguccgucguuucucuccugaucgggauugcuaaccuuggacugaauaucggccuccacuacaaaguggacgauagcaccacaauuaacaucccuaauaugaacgagaccaauccgacaaucaccaacauuacaaauaucauugugaacaagaaugaagagagaaccuuccugaaccuuacgaaaccccugugugaagucaauuccuggcauauccucucuaaggacaacgccauucggaucggggaggaugcgcacauucuggugacccgcgaaccuuaucugagcugcgacccccaaggauguagaauguuugcucucucccagggcacaacccugcgggggcgccaugccaauggaacaauccacgauagaucuccuuuccgggcccuuaucagcugggagaugggccaggcucccuccccuuacaacacccgcguugagugcauuggcuggagcucuacguccugucaugacgggaucagcagaaugucuauuugcaucuccggaccgaacaauaacgccagcgcuguggucugguaucggggccgccccgugacagaaauuccuucuuggguugggaauauccugagaacccaggaguccgaaugugugugccacaaaggaaucugucccgucgugaugacagauggcccugccaacaauaaggcggccaccaagauuaucuacuuuaaagaggggaagauucagaaaaucgaggaacuccaaggaaacgcucagcacguggaggaaugcagcuguuauggcgccgcuggcaugauuaagugcgucugccgggacaauuggaaaggggccaaccgccccaucaucaccauugauccggagaugaugacacauacguccaaguaccuguguucuaagauccuuaccgacacaagcagaccuaaugaucccaccaacggaaauugcgacgcgccuauuaucggcgggucccccgaucccggaguuaaaggcuucgccuaucuggacggggaaaacagcuggcucggacggacaauuucuaaggacucccgcagcggcuacgagaugcugaaagugccuaaugcugagaccgauacgcagucuggcccgacaagcuaccaacugaucgugaacaaucagaacugguccggguauucuggagccuuuauugacuacugggcuaacaagggcuguuucaaucccugcuuuuaugucgaacucaucagagggcggccuaaagagaucgaugugcuguggaccagcaacuccaugguugcccuuuguggaagcagagaacgccugggcucuugguccuggcacgacggggccgagauuaucuacuucaaguga

SEQ ID NO: 209018 - RNA, 1380 nt, Artificial Sequence
  derived and/or modified sequence opt5 from neuraminidase__InfluenzaA__AJS18481
augaaccccaaucagaagauuaccugcaucagcgccacaggcgugacgcuguccgucguuucucuccugaucgggauugcuaaccuuggacugaauaucggccuccacuacaaagugagcgacuccaccacaauuaacucuccuaauaugaacgagaccaauccgacaaccacaaacaucaccaauaucauugugaacaagaaugaagagagaacguuccugaaccuuaccaaaccccugugugaagucaauagcuggcauauccucuccaaggauaacgccauucggaucggggaggaagcgcacauucuggugacacgcgagccuuaucugucuugcgacccccaaggauguagaauguuugcucucagccagggcaccacacugcgggggcgccaugccaauggaaccauccacgauagauccccuuuccgggcccuuauuagcugggagaugggccaggcucccucuccuuacaacacgcgcguugaaugcaucggcugguccagcacaucuugucaugacgggaucuccagaaugagcauuugcaucucuggaccgaacaauaacgccuccgcuguggucugguaucggggccgccccgugaccgagauuccuagcugggccgggaauauccugagaacacaggaauccgaguguguuugccacaaaggaauuugucccguggucaugaccgauggcccugcgaacaauaaggccgcuaccaagaucaucuacuuucgggaggggaaaauucaaaagaucgaggaacuccagggaaacgcccagcacauugaagagugcucuuguuauggcgcugccggcaugaucaaaugcgcgugccgcgacaauuggaagggggccaacagacccauuaucacaaucgauccggaaaugaugacgcauaccagcaaauaccuguguuccaagauucuuacagacaccagccggccuaaugaucccacaaacggaaauugcgacgcuccugugaccggcgggucucccgaucccggaaucaagggcuucgccuuucuggacggggagaacuccuggcucggacgcacgauuagcaaaaauucuagaagcggcuaugagaugcugaaggugccuaacgcugaaacagauacccaguccggcccgaccucuuaccaacugaucgucaauaaccagaacuggagcggguacuccggagccuucauugacuauugggccaauaaagaguguuuuaaccccugcuucuacguugaacucauccggggcagaccuaaggagagcgacgugcuguggacaucuaauuccaugguggcucuuugugggagccgcgaacggcugggaucuugguccuggcacgauggcgcggagauuaucuauuuuaaauga

SEQ ID NO: 209019 - RNA, 1410 nt, Artificial Sequence
  derived and/or modified sequence opt5 from neuraminidase__InfluenzaA__AKA59350
augaaccccaaucagaagaucauuaccaucggcagcgugugcaugacaauuggggucgccaaccugauccuccaaauuggaaauaucaucuccauuuggaucucucacagcauucagcugggcaaccagaaucagaucgagacguguaaccaauccguuauuaccuacgaaaauaacacaugggugaaucagaccgacgugaacaucucuaauacaaacuucgcugccgggcagagcgucguguccguuaaacuugcgggaaauucuagccugugcccuguguccggcugggcuauuuauagcaaggauaacucuaucagaaucggguccaaaggagacgucuuugugauucgggagccguucaucagcuguucuccccucgaaugccgcaccuuuuuccugacacagggcgcccuucugaaugauaagcauuccaacggcaccauuaaagacagaagcccuuaccggacgcucaugucuugucccaucggggagguuccuucccccuauaacagccgcuuugaauccguggccuggucugcuagcgccugccacgauggaauuaauuggcugaccaucggcaucuccgggccugacaacggagcugucgccgugcugaaguacaauggcauuaucacagauaccauuaagagcuggagaaacaauauccuccggacacaagagucugagugugugugcgucaacggguccuguuucaccguuaugacggacggaccgagcaauggccaggcgucuuauaaaauuuuucgcaucgaaaagggcaaaaucgucaagagcguggagaugaacgcccccaauuaccauuaugaagagugcuccuguuacccugauucuagcgagauuacaugcgugugcagagacaacuggcacggguccaaucggcccugggugagcuucaaccagaaucuggaauaccagaucggauauauuuguucuggcaucuuuggggauaacccucgccccaaugacaaaaccggauccugcggcccgguuagcucuaacggggcuaacggagugaagggcuucuccuuuaaguacggcaauggggucuggauuggaagaacaaaaagcaucuccucucggaacggcuucgagaugauuugggauccuaauggguggaccggaaccgacaacaauuuuagcaucaagcaagacaucgugggcauuaacgaaugguccggguauucuggcagcuucguucagcaucccgagcuuacaggacuggauuguauccgcccuugcuucuggguggaacucauuagaggccggcccaaagagaauacggucuggaccuccgggagcucuaucuccuuuuguggagugaacagcgacacagucggcuggucuuggcccgauggggccgagcugccuuucaccauugacaaguga

SEQ ID NO: 209020 - RNA, 1410 nt, Artificial Sequence
  derived and/or modified sequence opt5 from neuraminidase__InfluenzaA__AKA59352
augaaccccaaucagaagaucauuaccaucggcagcgugugcaugacaauugggauggccaaccugaugcuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaaccuugcuguggggcagagcgucguguccaccaaacuggccggaaauucuagccucugcccuguuuccggcugggcgaucuacagcaaggacaacucuauuagaaucggguccaaaggagauguguucgucauccgggagccguuuauuagcuguucuccccuggaaugccgcacauucuuucuuacccagggcgcucugcucaaugacaagcauuccaacggcacgaucaaagauagaagcccuuaucggacccugaugucuugucccauuggggaggugccuucccccuacaacagccgcuucgaauccguugccuggucugccagcgcuugccacgacggaaucaauuggcugacaauuggcaucuccgggccugauaacggagccguggcuguccucaaguauaauggcaucauuaccgacacaaucaagagcuggagaaacaauauucugcggacccaagagucugagugugccugcgugaacggguccuguuuuacggugaugacagauggaccgagcgacggccaggcgucuuacaaaaucuuccgcauugaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuuuaaucagaaccuugaauaucagaucggauacaucuguucuggcauuuucggggauaauccucgccccaacgacaaaacaggauccugcggcccggucagcucuaauggggcuaacggagugaagggcuuuuccuucaaguauggcaacgggguuuggaucggaagaaccaaaagcauuuccucucggaauggcuuugagaugaucugggauccuaacggguggaccggaacagacaauaacuucagcauuaagcaagacaucgugggcaucaaugaaugguccggguacucuggcagcuuuguccagcaucccgagcugacgggacucgauuguauucgcccuugcuucuggguggaacugaucagaggccggcccaaagagaacaccauuuggacauccgggagcucuaucuccuucuguggaguuaauagcgacaccgugggcuggucuuggcccgauggggccgagcuuccuuuuacaauugacaaguga

SEQ ID NO: 209021 - RNA, 1410 nt, Artificial Sequence
  derived and/or modified sequence opt5 from neuraminidase__InfluenzaA__AKA59354
augaaccccaaucagaagaucauuaccaucggcagcgugugcaugacaauuggggucgccaaccugauccuccaaauuggaaauaucaucuccauuuggaucucucacagcauucagcugggcaaccagaaucagaucgagacguguaaccaauccguuauuaccuacgaaaauaacacaugggcuaaucagaccuaugugaacaucucuaauacaaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugcuuggucugccagcgcuugccacgacggaauuaauuggcugaccaucggcaucuccgggccugauaacggagccguggcgguccugaaguauaauggcauuaucacagacaccauuaagagcuggagaaacaauauccuccggacacaagagucugagugugugugcgugaacggguccuguuucaccgucaugacggauggaccgagcaauggccaggccucuuacaaaauuuuucgcaucgaaaagggcaaaaucguuaagagcguggagaugaacgcucccaauuaucauuacgaagagugcuccuguuacccugacucuagcgagauuacaugcgugugcagagauaacuggcacggguccaaucggcccugggucagcuucaaccagaaucuggaauaucagaucggauacauuuguucuggcaucuuuggggacaacccucgccccaaugauaaaaccggauccugcggcccggugagcucuaacggggccaacggaguuaagggcuucuccuuuaaguauggcaaugggguguggauuggaagaacaaaaagcaucuccucucggaacggcuucgagaugauuugggacccuaauggguggaccgaaaccgauaacaauuuuagcaucaagcaagacaucgucggaauuaacgagugguccggcuacucugggagcuucgugcagcaucccgaacuuacaggccuggacuguauccgcccuugcuucuggguugagcucauuagaggacggcccaaagagaauacgguguggaccuccggcagcucuaucuccuuuuguggggucaacagcgauacagugggauggucuuggcccgacggcgcugaacugccuuucaccauugauaaguga

SEQ ID NO: 209022 - RNA, 1380 nt, Artificial Sequence
  derived and/or modified sequence opt5 from neuraminidase__InfluenzaA__AKS48026
augaaccccaaucagaagauuaccugcaucagcgccacaggcgugacgcuguccgucguuucucuccugaucgggauugcuaaccuuggacugaauaucggccuccacuacaaagugagcgacuccaccacaauuaacaucccuaauaugaacgagaccaauccgacaaccacaaacaucaccaauauuaucgugaacaagaaugaagagagaacguuccugaaccuuaccaaaccccugugugaagucaauucuuggcauauucucagcaaggauaacgccauccggauuggggaggacgcgcacauccuggugacacgcgaaccuuaucuguccugcgauccccaaggauguagaauguuugcucucucucagggcaccacacugcgggggcgccaugccaauggaaccauucacgacaaaagcccuuucagagcccuuaucuccugggagaugggccaggcucccagcccuuacaacacgcggguugagugcaucggcuggucuuccacaagcugucaugaugggauuucucgcauguccaucugcauuagcggaccgaacaauaacgccucugcuguggucugguauagaggccggcccgugaccgaaaucccuuccuggguugggaauauucugcgcacacaggagagcgaaugugugugccacaagggaaucugucccgucgugaugaccgacggcccugccaacaauaaggcggccaccaaaaucauuuacuuuaaggaggggaaaauccaaaagauugaggaacuccagggaaacgcucagcacaucgaggaaugcuccuguuauggcgccgcuggcaugauuaaaugcgugugcagagauaauuggaagggggccaaccggcccaucaucacaauugacccggagaugaugacgcauaccucuaaguaccuguguagcaaaauccuuacagauaccucccgcccuaaugaccccacaaacggaaauugcgaugaaccuauuaccggcgggagccccgaccccggagucaagggcuucgcguuucuggauggggagaacucuuggcucggaagaacgaucuccaaagacagccggucuggcuaugagaugcugaagguuccuaaugccgaaacagacacccagagcggcccgaccuccuaccaacugauugugaacaaucagaacuggucuggguacagcggagcuuucaucgauuauugggccaacaaagaguguuuuaaucccugcuucuacguggaacucauucgcggcagaccuaaggagaucgacguccugugggcuuccaacagcaugguggcccuuugugggucucgggaaagacugggauccuggagcuggcacgauggcgccgagaucauuuauuuuaaauga

SEQ ID NO: 209023 - RNA, 1380 nt, Artificial Sequence
  derived and/or modified sequence opt5 from neuraminidase__InfluenzaA__AKS48040
augaaccccaaucagaagauuaccugcaucagcgccacaggcaugacgcuguccguggucucucuccugaucgggauugcuaaccuuggacugaauaucggccuccacuacaaaguuagcgacuccaccacaauuaacaucccuaauaugaacgagaccaauccgacaaccacaaacaucaccaauauuaucgugaacaagaaugaagagagaacguuccugaaccuuaccaaaccccugugugaagucaauucuuggcauauucucagcaaggauaacgccauccggauuggggaggacgcgcacauccuggugacacgcgaaccuuaucuguccugcgauccccaaggauguagaauguuugcucucucucagggcaccacacugcgggggcgccaugccaauggaaccauucacgacagaagcccuuuccgggcccuuaucuccugggagaugggccaggcucccagcccuuacaacacgcgcguggagugcaucggcuggucuuccacaagcugucaugaugggauuucuagaauguccaucugcauuagcggaccgaacaauaacgccucugcuguugugugguaucggggccgccccgucaccgaaaucccuuccuggguggggaauauucugagaacacaggagagcgaauguguuugccacaaaggaaucugucccguggucaugaccgacggcccugccaacaauaaggcggccaccaagaucauuuacuuuaaagaggggaagauccagaaaauugaggaacuccaaggaaacgcucagcacaucgaggaaugcuccuguuauggcgccgcuggcaugauuaagugcgugugccgggauaauuggaaaggggccaaccgccccaucaucacaauugacccggagaugaugacgcauaccucuaaguaccuguguagcaagauccuuacagauaccuccagaccuaaugaccccacaaacggaaauugcgaugcgccuauuaccggcgggagccccgaccccggagugaaaggcuucgccuuucuggauggggaaaacucuuggcucggacggacgaucuccaaggacagccgcucuggcuaugagaugcugaaagucccuaaugcugagacagacacccagagcggcccgaccuccuaccaacugauuguuaacaaucagaacuggucuggguacagcggagccuucaucgauuauugggcuaacaaggaauguuuuaaucccugcuucuacguggagcucauuagaggccggccuaaagaaaucgacgugcugugggccuccaacagcauggucgcccuuugugggucuagagagcgccugggauccuggagcuggcacgauggcgcugaaaucauuuauuuuaaguga

SEQ ID NO: 209024 - RNA, 1380 nt, Artificial Sequence
  derived and/or modified sequence opt5 from neuraminidase__InfluenzaA__ALO75898
augaaccccaaucagaagauuaccugcaucagcgccacaggcgugacgcuguccgucguuucucuccugaucgggauugcuaaccuuggacugaauaucggccuccacuacaaagugagcgacuccaccacaauuaacaucccuaauaugaacgagaccaauccgacaaccacaaacaucaccaauauuaucgugaacaagaaugaagagagaacguuccugaaccuuaccaaaccccugugugaagucaauucuuggcauauucucagcaaggauaacgccauccggauuggggaggacgcgcacauccuggugacacgcgaaccuuaucuguccugcgauccccaaggauguagaauguuugcucucucucagggcaccacacugcgggggcgccaugccaauggaaccauucacgacagaagcccuuuccgggcccuuaucuccugggagaugggccaggcucccagcccuuacaacacgcgcguugagugcaucggcuggucuuccacaagcugucaugaugggauuucuagaauguccaucugcauuagcggaccgaacaauaacgccucugcuguggucugguaucggggccgccccgugaccgaaaucccuuccuggguugggaauauucugagaacacaggagagcgaaugugugugccacaaaggaaucugucccgucgugaugaccgacggcccugccaacaauaaggcggccaccaagaucauuuacuuuaaagaggggaagauccagaaaauugaggaacuccaaggaaacgcucagcacaucgaggaaugcuccuguuauggcgccgcuggcaugauuaagugcgugugccgggauaauuggaaaggggccaaccgccccaucaucacaauugacccggagaugaugacgcauaccucuaaguaccuguguagcaagauccuuacagauaccuccagaccuaaugaccccacaaacggaaauugcgaugcgccuauuaccggcgggagccccgaccccggagucaaaggcuucgccuuucuggauggggaaaacucuuggcucggacggacgaucuccaaggacagccgcucuggcuaugagaugcugaaaguuccuaaugcugagacagacacccagagcggcccgaccuccuaccaacugauugugaacaaucagaacuggucuggguacagcggagccuucaucgauuauugggcuaacaaggaauguuuuaaucccugcuucuacguggagcucauuagaggccggccuaaagaaaucgacguccugugggccuccaacagcaugguggcccuuugugggucuagagagcgccugggauccuggagcuggcacgauggcgcugaaaucauuuauuuuaaguga

SEQ ID NO: 209025 - RNA, 1380 nt, Artificial Sequence; identical to SEQ ID NO: 209024
  derived and/or modified sequence opt5 from neuraminidase__InfluenzaA__ALO75910

SEQ ID NO: 209026 - RNA, 1380 nt, Artificial Sequence
  derived and/or modified sequence opt5 from neuraminidase__InfluenzaA__ALO75922
augaaccccaaucagaagauuaccugcaucagcgccacaggcgugacgcuguccgucguuucucuccugaucgggauugcuaaccuuggacugaauaucggccuccacuacaaagugagcgacuccaccacaauuaacaucccuaauaugaacgagaccaauccgacaaccacaaacaucaccaauauuaucgugaacaagaaugaagagagaacguuccugaaccuuaccaaaccccugugugaagucaauucuuggcauauucucagcaaggauaacgccauccggauuggggaggacgcgcacauccuggugacacgcgaaccuuaucuguccugcgauccccaaggauguagaauguuugcucucucucagggcaccacacugcgggggcgccaugccaauggaaccauucacgacagaagcccuuuccgggcccuuaucuccugggagaugggccaggcucccagcccuuacaacacgcgcguugagugcaucggcuggucuuccacaagcugucaugaugggauuucuagaauguccaucugcauuagcggaccgaacaauaacgccucugcuguggucugguaucggggccgccccgugaccgaaaucccuuccuggguugggaauauucugagaacacaggagagcgaaugugugugccacaaaggaaucugucccgucgugaugaccgacggcccugccaacaauaaggcggccaccaagaucauuuacuuuaaagaggggaagauccagaaaauugaggaacuccaaggaaacgcucagcacaucgaggaaugcuccuguuauggcgccgcuggcaugauuaagugcgugugccgggauaauuggaaaggggccaaccgccccaucaucacaauugacccggagaugaugacgcauaccucuaaguaccuguguagcaagauccuuacagauaccuccagaccuaaugaccccacaaacggaaauugcgaugaaccuauuaccggcgggagccccgaccccggagucaaaggcuucgcguuucuggauggggagaacucuuggcucggacggacgaucuccaaggacagccgcucuggcuaugagaugcugaaaguuccuaaugccgaaacagacacccagagcggcccgaccuccuaccaacugauugugaacaaucagaacuggucuggguacagcggagcuuucaucgauuauugggccaacaaggaguguuuuaaucccugcuucuacguggaacucauuagaggccggccuaaagagaucgacguccugugggcuuccaacagcaugguggcccuuugugggucuagagaacgccugggauccuggagcuggcacgauggcgccgagaucauuuauuuuaaguga

SEQ ID NO: 209027 - RNA, 1401 nt, Artificial Sequence
  derived and/or modified sequence opt5 from neuraminidase__InfluenzaA__ALT20083
augaaccccaaucagagaaucaccgccauuggcagcgugucccugaucauugcuaucauuugccuccugaugcaaaucgccauccuuacaacgaccaugacacugcacuuccggcagaacgaguguucuaauccuagcaacaaucaggucaugccgugcgaacccauuaucauugagcgcaacaccguucaucucaauuccacaaccaucgaaagagagauuuguccuaagguggcggaauacaaaaacuggucuaagccccagugccaaaucacaggguuugcuccuuucagcaaagacaauuccauucggcugucugccagcggagauaucugggugacccgcgagcccuaugucuccuguagccuuaacaagugcuaccaguuugcccugggccaggggacgacccucaaaaauaagcacucuaacggaacaacccaugacagaacaccucaccggacccugcugaugaaugagcucggcgugccguuccaucuggggacgaagcagguuuguaucgcuugguccuccucuuccugcuaugauggaaaagccuggcuucacgugugugucacaggcgacgauaagaacgcuaccgccagcauuaucuacgacggcaugcugguggauucuauuggguccuggagcaaaaauauccuccgcacacaagaauccgagugcguuuguauuaacggaaccugcgcgguggucaugaccgacggcucugccagcgggaaggcugauacaagagugcuguuuauccgggaaggaaaaaucauuaacaucagcccccuuagcggcucugcccagcacguggaggagugcuccuguuauccucgcuaccccgaagucagaugcguuugucgggacaauuggaaggggagcaaccgcccuauucuguauaucaauauggcugauuacucuauugagagcuccuacgugugcucuggacucgugggcgacacgcccagaaacgaugacagcuccucuagcuccaauugucgggacccgaacaaugaacgcggcgccccuggggucaagggaugggcguucgaugacggcaacgauguguggauggggagaaccaucaaaaauggaagccggucuggcuaugagacauuuagaguugugaacggguggaccauggccaauuccaagagccagaucaaccgccaggucauuguggacuccaaugauuggucuggauacagcggcaucuucuccguugaaggcaaaaagugcauuaaccgguguuuuuauguggagcugaucagagggcgcccccaagagccucgggucugguggacaucuaauagcauuaucguguucugcggaaccuccggcacguacgggacaggaagcuggcccgacggcgcuaacauuaacuuuaugcccaucuga

SEQ ID NO: 209028 - RNA, 1410 nt, Artificial Sequence
  derived and/or modified sequence opt5 from neuraminidase__InfluenzaA__AMA65392
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagccggggagauguguuuguuauccgcgagccguucauuucuuguagcccccuggaaugcagaaccuuuuuccucacacagggcgcccugcuuaacgacaaacauuccaauggcaccaucaaggaucggucuccuuaucgcacgcugauguccugucccauuggggaggugccuagccccuacaacuccagauuugaaucugucgccuggagcgcuuccgccugccacgacggaaucaacuggcucaccauuggcaucagcgggccugauucuggagcuguggccgugcugaaauauaauggcaucauuacagacaccaucaaguccuggcggaacaauauucugcgcacacaagagagcgagugugcgugcgucaacgggucuuguuucaccaucaugacggauggaccgagcgacggccaggccuccuacaagauuuuuagaaucgaaaaaggcaagaucauuaaaucuguugagaugaaggcucccaauuaucauuacgaagagugcagcuguuacccugauuccagcgagaucacaugcgugugccgggacaacuggcacgggucuaaucgccccuggguguccuucaaccagaaucucgaauaucagaugggauacauuuguagcggcgucuuuggggauaacccuagacccaaugacaaaaccggaucuugcggcccgguguccagcaacggggccaauggaguuaagggcuucuccuuuaaguauggcaacgggguguggaucggacggacaaaaucuauuagcucccgcaagggcuucgagaugaucugggauccuaauggguggaccggaaccgacaacaaauuuucuauuaagcaagacaucgucggcaucaacgaauggagcggguacuccggcagcuucgugcagcaucccgagcugacaggacuugauuguauuagaccuugcuucuggguugaacugauccggggccgccccgaggagaauacgauuuggaccucuggguccagcaucucuuuuuguggagugaacuccgacacagucggcuggagcuggcccgauggggcugaacucccuuucaccauugacaaauga

SEQ ID NO: 209029 - RNA, 1410 nt, Artificial Sequence
  derived and/or modified sequence opt5 from neuraminidase__InfluenzaA__AMA65394
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucacacagggcgcccugcuuaacgacaagcauuccaauggcaccaucaaagauagaucuccuuaucggacgcugauguccugucccauuggggaggugccuagccccuacaacucccgcuuugaaucugucgccuggagcgcuuccgccugccacgacggaaucaacuggcucaccauuggcaucagcgggccugauucuggagcuguggccgugcugaaguauaauggcaucauuacagacaccaucaaguccuggagaaacaauauucugcggacacaagagagcgagugugcgugcgucaacgggucuuguuucaccaucaugacggauggaccgagcgacggccaggccuccuacaaaauuuuucgcaucgaaaagggcaaaaucauuaagucuguugagaugaaagcucccaauuaucauuacgaagagugcagcuguuacccugauuccagcgagaucacaugcgugugcagagacaacuggcacgggucuaaucggcccuggguguccuucaaccagaaucucgaauaucagaugggauacauuuguagcggcgucuuuggggauaacccucgccccaaugacaagaccggaucuugcggcccgguguccagcaacggggccaauggaguuaagggcuucuccuuuaaauauggcaacgggguguggaucggaagaacaaagucuauuagcucccggaaaggcuucgagaugaucugggauccuaauggguggaccggaaccgacaacaaguuuucuauuaaacaagacaucgucggcaucaacgaauggagcggguacuccggcagcuucgugcagcaucccgagcugacaggacuugauuguauucgcccuugcuucuggguugaacugaucagaggccggcccgaggagaauacgauuuggaccucuggguccagcaucucuuuuuguggagugaacuccgacacagucggcuggagcuggcccgauggggcugaacucccuuucaccauugacaaguga

SEQ ID NO: 209030 - RNA, 1410 nt, Artificial Sequence
  derived and/or modified sequence opt5 from neuraminidase__InfluenzaA__BAA00618
augaaccccaaucagaagaucauuaccaugggcagcguguccaucauuaucgccauugucugccugcucaugcaaaucgcuauccugguuacaacggugacccuucacuucagacagcaugagucugacagcccuccguccaaccaggugauucccugugaaccuaucauuaucgagcggaauauuacagaaaucgucuaccugaacaauaccacaauugagaaagaaaccugccccaagucuguggaguaucgcaacuggagcaaaccucaguguaagaucacaggguuugcccccuucuccaaagauaauucuaucagacucagcgcgggaggcgacauuuggguuacccgggagccuuacguguccugcgauccggggaaguguuaucaauuugcucugggacagggcacgacccuugacaacaagcacagcaaugauacaauccaugaccgcauuccccacagaacccugcucaugaacgaacugggggucccuuuccaucugggaacacgccaggugugcaucgccuggucuuccagcucuugucacgauggcaaagccuggcuccacguuugcgugaccggcgacgauaagaaugcuacggccuccuuuauuuacaacgggcggcuggucgacagcaucggaucuuggucccagaauauccuuagaacacaagagagcgaaugugugugcauuaacggcaccuguacaguggucaugaccgauggguccgcuucuggacgggccgacacccgcauccuguucauugaggagggcaaaaucguucauauuagcccccucuccgggagcgcgcagcacguggaagagugcucuugcuauccuagauaccccgaugugcgguguaucugccgcgacaauuggaagggauccaacagcccggucguggacaucaacaugaaagauuauucuauugacagcuccuacguuuguucuggccuggugggcgauacaccuagaaaugacgaucggagcuccaagagcaacugccgcaaucccaacaaugaaagagggaaccauggagucaagggcugggccuuugacaauggggaugacguguggaugggacggacgaucucuaaagaucuuagauccggcuacgagaccuucaagguuauugggggauggagcacaccuaacucuaaaucccagaccaaucgccaggugaucgucgacagcaacaauugguccggcuauucuggcauuuuuagcguggaagggaaguccuguaucaaccggugcuucuacgucgagcugauuagaggacgcaaacaagagacacgggugugguggaccucuaauagcaucguuguguuuuguggcacguccgggacauauggaaccggcagcuggcccgauggggcuaacaucgacuucaugcccauuuga

SEQ ID NO: 209031 - RNA, 1410 nt, Artificial Sequence
  derived and/or modified sequence opt5 from neuraminidase__InfluenzaA__BAA00619
augaaccccaaucagaagaucauuaccaucggcagcguuucccugacauucgccgcuauuugcuuucucaugcaaaucgccauucuggucacgaccguuacacuuaacuucaaacaguacgagugugacccuccggcgaccaaucaggugaugcccugcgaaccuaucaucauugagagaaacaucacagaaauuguguaucugaccaauacaaccaucgagcgggaaauuugucccaagcucgucgaguaccgcaacuggucuaaaccucagugcaagaucacgggguuugcucccuucagcaaagauaauuccauuagacugucugccggaggcgacaucugggugacccgggagccuuauguuagcugugauccggggcgcugcuaccaauuugcccuuggacagggcacaacccuggacaacaagcacuccaaugauacaauccaugacagaacgccccaccggacccuccugaugaacgaacugggggugccuuuccaucucggaacacgccaggucuguauugcuuggucuagcuccagcugccacgauggcaaggccuggcugcauguguguaucaccggcuaugacaaaaaugcuacagccucuuuuauuuacgaugggagacuuguugacuccaucggaagcuggucuaagaacauucugcggacccaggaguccgaaugcguguguaucaaugggaccugcacagucgugaugacggauggcagcgcgucuggacgcgccgacaccagaauccucuucauugaggagggccggaucgugcacauuagcccccuguccggguccgcucaacacgucgaagagugcucuuguuauccucgcuaccccggaguuagaugcaucugucgggauaacuggaaaggcagcaaucgcccggugguggacauuaacgucaaggacuacuccaucaacagcucuuaugugugcuccggccuuguuggggauacaccuagaaauaacgaccggagcucuaauagcuacugucagaaccccaauaacgaaaaaggaaaucauggcgugaaggggugggccuuugaugacggaaacgaugucuggaugggcagaaccaucuccgaggacucucgcagcggguaucagacauucaaggugauuggaggcugguccaccccuaauagcaaacugcagaucaaccggcaaguuauuguggauucugacaauagauccggcuacagcgggaucuuuucugucgaaggaaaguccugcauuaaccgcuguuucuauguggagcucauccggggcagacgccaggagacgcgggucugguggacaagcaauuccauugugguguuuugcgggaccucuggaaccuacggcacagggagcuggcccgauggcgcugacaucaaccugaugcccaucuga

SEQ ID NO: 209032 - RNA, 1410 nt, Artificial Sequence
  derived and/or modified sequence opt5 from neuraminidase__InfluenzaA__BAA00620
augaaccccaaucagaagaucaugaccauuggcagcgugucccugaucauugccgcugucugcuuccucaugcaaaucgccauucugguuacaacggugacccuucacuuuaaacagugugagugcgacucuccuagcaacaaucaggugaagccgugugaacccaucaucauugagagaaacaucacagaaauugucuaccugaauaacaccacaaucgagaaagaaaccugcccuaagcucguggaguaucggaauugguccaaaccccaguguaagauuacaggguucgcgccuuuuucuaaggauaacagcauccgccuguccgcuggaggcgacauuuggguuaccagagagcccuacgugucuugcgauccugggaaauguuaucaauucgcccuuggacagggcacgacccuggacaauaagcauagcaacgauacaauccacgaccggaucccgcaucgcacccuccugaugaaugaacuggggguccccuuucaccucggaacaagacaggugugcauugccugguccuccucuuccugucaugauggcaaggcuuggcugcacguuugcgugaccggcgacgauaaaaacgccacggcuagcuucaucuacgacgggcggcuugucgauucuauuggauccuggagccagaauauccugcgcacacaagagucugaaugugugugcauuaacggaaccugcacaguggucaugaccgacggguccgccagcggcagagcggauacccggauccucuuuaucgaggagggcaaaauuguucacaucuccccucugucugggagcgcccagcauguggaagaguguuccugcuauccccgcuacccuaaugugagauguauuugccgggacaacuggaagggaagcaaccgccccaucgucgacauuaauaugaaggauuauucuaucgacuccagcuacguguguucuggccuuguuggcgauacaccgagaaacgacgaucggagcuccaaaucuaauugccgcaacccuaauaacgaaaaggggaaucacggagugaaaggcugggcuuucgacaacggggaugacgucuggaugggaagaacgaucagcaaggaucugcgguccggcuacgagaccuuuaaagugauugggggaugguucacacccaauagcaagucucagguuaacagacaggugaucgucgacuccgauaaucgcagcggcuauucuggcauuuuuagcguggaagggaaaagcuguaucaaccggugcuucuacgucgagcucauuagaggacgcggccaagagacccgggugugguggacauccaauucuaucguuguguuuugugggaccagcggaacguauggcaagggguccuggccugacggcgccaacauuaauuucaugcccaucuga

SEQ ID NO: 209033 - RNA, 1410 nt, Artificial Sequence
  derived and/or modified sequence opt5 from neuraminidase__InfluenzaA__BAA00621
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcccucuguccgggucugcccagcauguugaagagugcagcuguuauccccgguacccuggagugcgcugcauuuguagagauaacuggaagggcuccaaucggcccguggucgacaucaacgugaaggacuacagcauugauucuuccuauguuugcagcggccuugugggggacaccccgcgcaaaaacgauagaucuagcuccucuuacugucggaauccuaacaaugaaaagggaacacacggcgucaaagggugggcuuucgacgauggaaacgacguguggaugggccgcaccaucagcgaggauuccagaagcggguaugaaacguuuaagguuaucggaggcuggucuacacccaauuccaaacugcagauuaacagacaggugaucgucgacagcaaugaucggucuggcuacuccgggauuuucagcguggagggaaaguccugcaucaaccgcuguuuuuaugucgagcucauucggggcagagaacaagagacccgcgugugguggaccucuaauagcaucguuguguucugcgggacauccggaaccuacggcacagggucuuggccugacggcgccgauauuaaccugaugcccaucuga

SEQ ID NO: 209034 - RNA, 1413 nt, Artificial Sequence
  derived and/or modified sequence opt5 from neuraminidase__InfluenzaA__BAA06714
augaaccccaaucagaagaucauuaccaucggcagcauuuccauggccaucgggauuaucucucugauccuccaaauuggaaacaucauuagcaucugggugucccacucuauucagacaggcagccagaaucauacggggaucugcaaccagagaauuaucaccuacgagaauagcacaugggucaaccaaaccuauguuaauaucaacaauacaaacgugguggcuggaaaagacaagaccucugucacacuggccggcaauagcucccuuuguccuauucgggggugggcgaucuacaccaaagauaacagcauucgcaucggaucuaagggcgacguguucguuauuagagaaccguuuaucuccugcagccaccuggagugucggacguucuuucucacccagggcgcucugcuuaaugauaaacauucuaacgggacagugaaggaccgcucccccuauagacggcugaugagcugcccucucggagaagcccccucuccuuacaauucccgcuucgagagcaucgccugguccgcuucugccugucacgauggcaugggguggcugaccauuggaaucagcggccccgacgauggggcugucgccgugcugaaguauaacggaauuaucacagaaaccauuaaauccuggaagaaaagaauccuccggacgcaggagagcgagugcguuugugugaacggcucuugcuuuacaaucaugaccgacggcccuuccaaugggcaggcgagcuaccgcauuuucaagaucgaaaaaggaaaggucacaaagucuauugagcuggaugccccgaacagccauuaugaagaguguuccugcuaccccgacaccggcaccgugaugugugugugcagagauaauuggcacgggucuaaccggccuugggucagcuuuaaucaaaaccuugacuaccagaucggauauauuugcuccggcguuuucggggauaaucccccucccaaagacggaaagggcagcugugacccggugacaguggauggcgcugacggggucaaaggauuuucuuaccgcuauggcaacgggguguggaucggaagaacgaaguccaaucgguuccgcaaaggcuuugagaugauuugggauccuaacggguggaccgacacagauagcgacuuccugguuaagcaggauguggucgccaugaccgacuggucuggcuacuccggauccuuugugcagcaccccgaacucacaggccuggauugcaugagaccuuguuucuggguugagcuugugcgggggagaccccgcgaaaauaccacgaucuggacauccggaucuagcaucuccuucugcggcgucaacucugacaccgcuaauuggagcuggcccgauggggccgagcugccuuuuaccauugacaaauga

SEQ ID NO: 209035 - RNA, 1413 nt, Artificial Sequence
  derived and/or modified sequence opt5 from neuraminidase__InfluenzaA__BAA06715
augaaccccaaucagaagaucauuaccaucggcagcauuuccauggccaucgggauuaucucucugauccuccaaauuggaaacaucauuagcaucugggcuucccacucuauucagacaggcagccagaaucauacggggaucugcaaccagagaauuaucaccuacgaaaauuccacaugggugaaccaaaccuaugucaauaucaacaauacaaacguuguggccggaaaagacaagaccucugugacacuggcgggcaauagcucccuuuguccuauucgggggugggcuaucuacaccaaagauaacagcauucgcaucggaucuaagggcgacgucuucgugauuagagagccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggcaugggguggcugaccaucggaauuagcggccccgacaacggggcggucgccgugcugaaguauaacggaaucauuacagaaaccaucaaauccuggaagaaacgcauucucagaacgcaggagagcgagugcguuugugugaauggcucuugcuuuacaaucaugaccgauggcccuuccaacggggcugccagcuaccggaucuucaagauugaaaaaggaaaggucacaaagucuaucgagcuggacgcuccgaauuaucauuacgaagaguguagcugcuaccccgauaccggcaccgugaugugugugugccgcgacaacuggcacggguccaauagaccuucugucagcuuuaaccagaaucuugauuaucaaauuggauacaucugcuccggcguuuucggggacaacccccggccuaaagauggagagggcagcuguaaucccgugacaguggacggcgccgacggggucaagggauuuucuuaucgcuacggcaacgggguguggauuggaagaacgaaauccaaucggcugcgcaagggcuucgaaaugaucugggauccgaacggguggaccgacacagauagcgacuuuucuguuaaacaggauguggucgcgaugaccgacugguccggcuauagcggauccuucgugcagcacccugagcucacaggccuggauugcaugagacccuguuuuuggguugaacuuauucgggggagaccucgcgagaagaccacgaucuggacaucuggaagcuccaucucuuucugcggcgugaauagcgacaccgccaacugguccuggcccgauggggcugaacugcccuucaccauugacaaauga

SEQ ID NO: 209036 - RNA, 1410 nt, Artificial Sequence
  derived and/or modified sequence opt5 from neuraminidase__InfluenzaA__BAA06716
augaacaccaaucagagaaucauuacaaucggcacgauuugccugaucguggggauuaucagccuccugcuucaaaucggaaacauuauccugcucuggaugucccacucuauucagaccggcgaaaagagccaucccaaagucuguaaucaguccguuaucacauacgagaacaauaccugggugaaccagacauaugugaauauuucuaacaccaauaucgccgcugggcaaggagucacaccuauuauccuggccggcaacagcucccuuugcccgaucucugggugggcgauuuacagcaaggacaauuccauccggauuggaagcaaaggcgauaucuucgugaugcgcgagcccuuuauuucuuguucccaccuggaaugcagaaccuucuuucucacgcagggcgcucugcugaacgaccggcauagcaaugggaccguuaaggaucgcucuccuuauagaacacucauguccugucccaucggagaggccccuagccccuacaacucucgguucgaauccguggccuggagcgcuuccgccugccacgacggcaugggguggcugaccaucggaauuucuggcccugauaauggggcugucgccgugcuuaaauauaacggaaucauuacagacaccaucaagagcuggcgcaacaagauucugagaacgcaggaguccgaguguguuugcaucaauggcagcuguuuuacaaucaugaccgauggcccgucuaacgggcaggcguccuacaaacucuucaagauggaaaaaggaaagauuaucaaaagcauugagcuggacgcccccaauuaucauuacgaagagugcucuuguuacccugauacaggcaagguggucugcgugugccgggacaacuggcacgcuagcaaucgccccuggguguccuuugaucaaaaccuugacuaucagaucggguacauuuguucuggagucuucggcgauaauccuagaagcaacgacgggaagggaaauugcggccccguucuguccaacggcgccaauggggugaaaggauuuagcuuccgguauggcaacgggguguggaucggacgcaccaagucuauuuccagcagacggggcuuugagaugaucugggacccgaauggguggaccgaaacagauucuuccuucagcaugaaacaggacaucauugcucucacggauugguccggcuacucuggcagcuuuguccagcacccugagcugaccggaaugaacuguauccgccccugcuucuggguggaacugauuagagggcaaccuaaggaguccacaaucuggaccucuggaagcuccauuagcuucuguggcguuaauucugggacagccuccuggagcuggcccgacggagcggaucuccccuuuaccaucgacaaauga

SEQ ID NO: 209037 - RNA, 1413 nt, Artificial Sequence
  derived and/or modified sequence opt5 from neuraminidase__InfluenzaA__BAA06717
augaaccccaaucagaagaucauuaccaucggcagcauuuccauggccaucgggauuaucucucugauccuccaaauuggaaacaucauuagcaucugggcuucccacucuauucagacaggcagccagaaucauacggggaucugcaaccagagaaugauuaccuacgaaaauuccacaugggugaaccaaaccuaugucaauaucucuaacacaaauguuguggccggaaaagacaagaccagcgugacacuggcgggcaacuccagccuuuguccuauccgggggugggcuauuuacaccaaagauaauucuauccgcauuggauccaagggcgacgucuucgugaucagagagccguuuauuagcugcucucaccuggagugucggacguucuuucucacccagggcgcccugcuuaacgauaaacauuccaaugggacaguuaaggaccgcagccccuauagagcccugaugucuugcccucucggagaagcucccuccccuuacaacagccgguucgaguccguggccuggucugcuagcgccugucacgauggcaugggguggcugaccaucggaaucuccggccccgacgauggggcggucgccgugcugaaguauaauggaauuaucacagaaaccauuaaaagcuggcgcaagcagauccucagaacgcaggagucugagugcguuugugugaacggcuccugcuuuacaauuaugaccgacggcccuagcgaugggccggcuucuuaccggaucuucaaaaucgaaaagggaaaagucacaaagagcauugagcuggacgcccccaacuaucauuacgaagaguguuccugcuacccugauaccggcaccgugaugugugugugccgcgacaauuggcacgggucuaacagacccugggucagcuuuaaucaaaaccuugauuaucagaucggauacauuugcuccggcguuuucggggacaauccucggcccaaggacggagagggcagcuguaacccggugacaguggauggcgcugacggggucaaaggauuuucuuaucgcuacggcaaugggguguggaucggaagaacgaaguccaaccggcugcgcaaaggcuucgaaaugauuugggauccuaauggguggaccgacacagauagcgacuuuucuguuaagcaggauguggucgccaugaccgacugguccggcuauagcggauccuucgugcagcaccccgagcucacaggccuggauugcaugagaccuuguuuuuggguugaacuuauccgggggagaccccgcgagaaaaccacgauuuggacaucuggaagcuccaucucuuucugcggcgugaacagcgacaccgcgaauugguccuggcccgauggggccgaacugccuuucaccaucgacaaguga

SEQ ID NO: 209038 - RNA, 1413 nt, Artificial Sequence
  derived and/or modified sequence opt5 from neuraminidase__InfluenzaA__BAA06718
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaccuucuuucucacgcagggcgcccugcuuaaugauaaacacuccaacgggaccgugaaggaccggagccccuaccgcagacugaugucuuguccuaucggagaagcccccuccccuuauaauagccgguucgaguccgucgcuuggucugccagcgcuugccaugauggcaugggguggcucacaauuggaaucuccggccccgacgauggggccguggcgguucugaaauacaacggaauuaucaccgaaacaauuaagagcuggcgcaagagaauccugcggacccaggagucugagugugugugcgucaacggcuccuguuuuacgaucaugacagacggcccuaauaacgggccggccagcuaucgcauuuucaaaaucgaaaagggaaaaauuaccaagucuaucgagcucgaugcucccaauagccacuacgaagagugcuccuguuacccugacgccggcacagugaugugcgugugcagagauaacuggcaugggucuaaucggcccugggucagcuuuaaccaaaaucuggacuaucagauuggauacaucuguuccggcguuuucggggauaacccucgccccaaagacggaaagggcagcugcgacccggugaccguggauggcgcugacggggucaagggauuuucuuauagauacggcaaugggguguggauuggacggaccaaauccaacagcucucgcagaggcuucgagaugaucugggauccuaauggguggacagacacggauuccaaguuucuuguuaaacaggacguggucgccaugaccgauuggagcggcuauuccggaucuuucgugcagcaccccgaacugacaggccucgacuguaugcggccuugcuuuuggguugagcuggugagagggcgcccccgggaaaacaccacaaucuggaccagcggauccucuauuagcuucuguggcgucaauggggauacggcgaacugguccuggcccgacggagccgagcuuccuuucacaaucgauaaguga

SEQ ID NO: 209039 - RNA, 1413 nt, Artificial Sequence
  derived and/or modified sequence opt5 from neuraminidase__InfluenzaA__BAA06720
augaaccccaaucagaagaucauuaccaucggcagcauuuccauggccaucgggauuaucucucugauccuccaaauuggaaacaucauuagcaucugggugucccacucuauucagacaggcagccagaaucauacggggaucugcaaccagagaauuaucaccuacgaaaauuccacaugggucaaccaaaccuauguuaauaucaacaauacaaacgugguggcuggaaaagacaagaccucugucacacuggccggcaauagcucccuuuguccuauucuggggugggcgaucuacaccaaagauaacagcauucggaucggaucuaagggcgacguguucguuauucgcgagccguuuaucuccugcagccaccucgaguguagaacguucuuucugacccagggcgcccuucugaaugauaaacauucuaacgggacagugaaggaccggucccccuaucgcagacucaugagcugcccucugggagaagcucccucuccuuacaauucccgguucgagagcgucgccugguccgcuucugccugucacgauggcaugggguggcugaccaucggaauuagcggccccgacgauggggcuguggccguucucaaguauaacggaaucauuacagaaaccaucaaauccuggaagaaacgcauucugagaacgcaggagagcgagugcgugugugucaacggcucuugcuuuacaaucaugaccgacggcccuuccaauggggcggccagcuaccggaucuucaagauugaaaaaggaaaggugacaaagucuaucgagcuugaugcuccgaacagccauuaugaagaguguuccugcuaccccgacaccggcaccgugaugugugucugccgcgauaauuggcacgggucuaacagaccuuggguuagcuuuaaucagaaccuggacuaccaaauuggauauaucugcuccggcguguucggggauaaucccccucccaaagacggaaagggcagcuguaacccggugacagucgacggcgccgauggggugaaaggauuuucuuaccgguauggcaaugggguuuggauuggacgcacgaaguccaacagauuccggaaaggcuuugagaugaucugggacccuaauggguggaccgauacagacagcgauuucucugugaagcaggacgucguggcuaugaccgauugguccggcuacagcggauccuuuguucagcaccccgaacucacaggccuggacugcaugcgcccuuguuucuggguggagcuugucagagggcggcccagagaaaacaccacgauuuggacaucuggaagcuccaucucuuucugcggcgugaauagcgauaccgccaacugguccuggcccgacggggcggagcugccuuuuaccaucgauaaauga

SEQ ID NO: 209040 - RNA, 1410 nt, Artificial Sequence
  derived and/or modified sequence opt5 from neuraminidase__InfluenzaA__BAD16637
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccauuuccaaggacagccggucuggguacgaaacauuuaaggugaucggaggcugguccaccccuaauagcaaaucucagguuaacagacaagugauugucggcaauaacaauugguccggguauagcggaaucuucuccguggagggcaagucuugcauuaaccgcuguuuuuacgucgagcuuauccgggggaugccccaggaaacaagagugugguggaccagcaauuccauuguuguguucugcggaacgucuggcacauaugggaccggcagcuggcccgauggagcuaacaucaauuuuaugccuaucuga

SEQ ID NO: 209041 - RNA, 1410 nt, Artificial Sequence
  derived and/or modified sequence opt5 from neuraminidase__InfluenzaA__BAD16638
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaugaaucugagugcguguguauuaaugggacaugcaccgucguuaugaccgauggauccgcgagcggcagagccgacacacggauccuguuuaucaaggaggggaaaauugugcacaucuccccucucucuggaagcgcucagcauauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccauuaauaaggacucccggagcggguacgaaacauuuaaggugaucggaggcuggucuaccccuaacuccaaaagccagguuaauagacaggugauugucgauaacaauaacuggucuggcuauuccgggaucuucagcguggagggaaaguccugcauuaaucgcuguuuuuacgucgagcuuauccggggcagaccccaagaaacacgcgugugguggaccucuaacagcauuguuguguucugcgggacguccggaacauauggcaccgggucuuggcccgacggcgcuaauaucaacuuuaugccuaucuga

SEQ ID NO: 209042 - RNA, 1410 nt, Artificial Sequence; identical to SEQ ID NO: 206221
  derived and/or modified sequence opt5 from neuraminidase__InfluenzaA__BAD16639

SEQ ID NO: 209043 - RNA, 1410 nt, Artificial Sequence
  derived and/or modified sequence opt5 from neuraminidase__InfluenzaA__BAD16640
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccugaggugguugaguaucggaacugguccaaaccccagugccaaaucaccggguucgcgccuuuuucuaaggauaauagcauucgccucuccgcuggaggcgacaucugggugacgagagaacccuacgucucuugugauccugggaaaugcuaucaguucgcccugggacagggcaccacacuugacaacaagcacagcaaugauaccauccaugaccggauuccgcaccgcacacugcucaugaacgagcugggggugcccuuucaucugggaaccagacagguuuguguggccugguccucuagcuccugccacgauggcaaggcuuggcuccacgucugugugacgggcgacgauaaaaaugccacagcuagcuucaucuacgacgggcggcugauggauucuauuggauccuggagccaaaacauccuucgcacccaggaaucugagugcguguguauuaauggcacaugcaccgucguuaugaccgacggguccgccagcggcagagcggauacacggauccuguuuaucgaggaaggaaagauugugcauaucuccccucucucugggagcgcccagcacguggaggaaugcuccuguuauccccgcuacccugacgucagaugcauuugucgggacaacuggaaaggaagcaaucgccccgugaucgauauuaacauggaggacuauucuaucgauuccagcuacguuugcucuggccuggugggcgacacgccgagaaacgaugaccggagcuccaauucuaacugucgcaauccuaacaaugaaagagggaaccccggagucaagggcugggcuuucgauaauggggacgauguguggaugggacggaccaucagcaaagaccuuagauccggcuacgagacauuuaagguuauugggggauggagcaccccuaacucuaagucccagaucaaucgccaagugauugucgauagcaacaauuggucuggcuauuccggcaucuucagcguggaggggaaauccugcauuaaccgguguuuuuacgucgaacugaucagaggacgccagcaggagacacgggugugguggaccucuaauagcauuguuguguucugcggcacguccgggacauauggaaccggcucuuggcccgacggggccaacaucaauuuuaugcccaucuga

SEQ ID NO: 209044 - RNA, 1410 nt, Artificial Sequence
  derived and/or modified sequence opt5 from neuraminidase__InfluenzaA__BAD16641
augaaccccaaucagaagaucauuaccaucggcagcgccucccugacaauugcuacggugugcuuccucaugcaaaucgccauucuggucaccacaguuacccuucacuuuaaacagcaugagugugacucuccugcgagcaaccaggugaugccgugcgaacccaucaucauugagagaaauacaaccgaaaucguguaccugaacaauacaaccauugagaaggaaaucuguccuaaagucguggaguaucggaacugguccaagccccagugcaaaauuacgggguucgcuccuuuuucuaaggauaauagcauccgccucuccgccggaggcgacauuuggguuaccagagagcccuacgugucuugugauccugggaagugcuaucaauucgcccugggacagggcacaacccuugacaacaaacacagcaaugauacaauccaugaccggaucccgcaccgcacccugcucaugaacgaacuggggguccccuuucaucugggaacgagacagguguguauugcuugguccucuagcuccugccacgauggcaaggccuggcuccacguuugugugacaggcgacgauaaaaaugcuaccgccagcuucaucuacgacgggcggcuggucgauucuauuggauccuggagccagaacauccuucgcacacaagagucugaaugcguguguauuaauggaaccugcaccguggucaugacagacggguccgcgagcggcagagccgauacgcggauccuguuuaucgaggagggcaagauuguucauaucuccccucucucugggagcgcucagcacguggaagagugcuccuguuauccccgcuacccugacgugagaugcauuugucgggacaacuggaaaggaagcaaucgccccgucguggauaucaacauggaagacuauucuauugauuccagcuacguuugcucuggccuggugggcgacaccccgagaaacgaugaccggagcuccaauucuaacugucgcaauccuaacaaugagaaggggaaccagggagucaagggcugggccuucgauaauggggacgauguguggaugggaagaacaaucagcaaagaccuucgguccggcuacgaaaccuuuaagguuaucgggggauggagcacacccaacucuaaaucccagauuaauagacaagugaucgucgauagcgacaaccgcucuggcuauuccggcauuuucagcguggaggggaaguccugcaucaaucgguguuuuuacgucgagcugauuagaggacgcaaacaggaaacccgggugugguggacgucuaacagcaucguuguguucugcggcacauccgggaccuauggaaccggcucuuggccugacggggcuaauauuaaccucaugcccaucuga

SEQ ID NO: 209045 - RNA, 1410 nt, Artificial Sequence
  derived and/or modified sequence opt5 from neuraminidase__InfluenzaA__BAD16642
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgauaaggagaaauguccuaaggugguugaauaccggaacugguccaaaccccagugccaaauuaccggguucgcgccuuuuucuaaggacaauagcauccgccucuccgcuggaggcgauauuugggugacgagagagcccuaugucucuugugaccaugggaagugcuaccaguucgcccugggacagggcaccacacuugauaacaaacacagcaaugacaccauccaugaucggaucccucaccgcacacugcucaugaacgagcugggggugccguuucaucugggaaccagacagguuuguauugccugguccuccucuuccugccacgacggcaaggcuuggcuccacguguguaucacgggcgaugacaaaaaugccacagcuagcuucauuuaugaugggcggcuggucgacucuaucggauccuggagccaaaacauucuucgcacccaggaaucugagugcguguguaucaauggcacaugcaccguggucaugaccgauggguccgccagcggcagagcggacacacggauccuguuuauugaagagggaaagaucguucauauuagcccccucucugggagcgcccagcacguggaggaaugcuccuguuacccucgcuaucccggagugagaugcaucugucgggacaacuggaaaggcagcaaucgcccugucguggauauuaacauggaggacuacucuaucgauuccagcuacguuugcucuggccuggugggggacacgcccagaaacgaugaccggagcuccaauucuaacugucgcaauccgaacaaugaaagaggaaaccagggcgucaaggggugggcuuucgauaauggagacgauguguggaugggccggaccaucagcaaggaccuuagauccggguaugagacauuuaaaguuauuggaggcuggagcaccccuaacucuaagucccaaaucaaucgccaggugauugucgauagcgacaaccggucuggcuacuccgggaucuucagcguggaaggaaaauccugcauuaauagauguuuuuaugucgagcugauccgcggccggaagcaggagacaagagugugguggaccucuaacagcauuguuguguucugcgggacguccggaacauacggcaccgggucuuggcccgacggcgccaauaucaacuuuaugccuaucuga

SEQ ID NO: 209046 - RNA, 1410 nt, Artificial Sequence
  derived and/or modified sequence opt5 from neuraminidase__InfluenzaA__BAD16643
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacacaccgcgcaacaaugauagaucuagcaacuccuacugucggaauccuaacaaugaaaaaggaaaccacggcgucaaggggugggcuuucgacgauggaaaugacguguggaugggccgcaccaucucugaggauagcagauccggguaugaaacauuuaaaguuauuggaggccuguucacccccaacagcaagcuccagaucaauagacaggugauugucgacucugauaaccgguccggcuacagcgggaucuuuucuguggagggaaaauccugcauuaaucgcuguuucuaugucgagcugauccggggcagagaacaagagacgcgcgugugguggacaagcaacuccauuguuguguuuugcgggaccucuggaaccuacggcacagggagcuggccugacggcgccgauaucaaucugaugcccaucuga

SEQ ID NO: 209047 - RNA, 1410 nt, Artificial Sequence
  derived and/or modified sequence opt5 from neuraminidase__InfluenzaA__BAD16644
augaaccccaaucagaagaucauuaccaucggcagcgugucccugacaauugccacgaucugcuuccucaugcaaauugcuauccuggucaccacaguuacccuucacuuuaaacaguacgagugugacucuccuccgaacaaucaggugaugcccugcgaaccuaucauuaucgagagaaacauuacagaaaucguguaucugaccaauacaaccauugagaaggaaaucugucccaaacucgucgaguaccggaacuggagcaagccucagugcaaaauuacgggguucgcccccuuuuccaaggauaauucuauccgccugagcgcgggaggcgacaucugggugaccagagagccuuauguuuccugugauccggggaagugcuaccaauucgcucuuggacagggcacaacccuggacaacaaacauucuaaugauacaauucacgaccggacgccccaucgcacccuccugaugaacgaacugggggugccuuuucaccucggaacaagacaggucuguaucgccuggagccgguccagcugccaugauggcaaggccuggcugcacguguguguuaccggcuaugacaaaaaugcuacagccucuuucauuuacgaugggcgccuuguggacuccaucggaagcuggucuaagaacauucugagaacccaggaguccgaaugcgucuguaucaaugggaccugcacaguggugaugacggauggcagcgcuucuggacgggccgacaccaaaauccucuuuauugaggagggcaagaucguccacauuagcccccuguccggguccgcgcaacauguugaagagugcucuuguuauccucgcuaccccggagugagaugcaucugucgggauaacuggaagggcagcaaucgcccgguggucgacauuaacgugaaagacuacuccaucgauagcucuuauguuugcuccggccuugugggggacacaccuagaaacaaugaucggagcucuaacagcuacugucgcaaucccaacaaugaaaagggaaaccacggcgucaaagggugggccuucgacgauggaaaugacguguggaugggcagaaccaucuccgaggauucucggagcgggugcgaaacauuuaagguuauuggaggcugguccaccccuaacagcaaacugcagaucaauagacaggugauugucgacucugauaaccgcuccggcuauagcgggaucuucucuguggagggaaaguccuguauuaaucggugcuuuuacgucgagcucaucagaggccgcgaacaggagacgcgggugugguggacaagcaacuccauuguuguguucugugggaccucuggaaccuauggcacagggagcuggcccgacggcgcugauaucaaucugaugcccaucuga

SEQ ID NO: 209048 - RNA, 1410 nt, Artificial Sequence; identical to SEQ ID NO: 197600
  derived and/or modified sequence opt5 from neuraminidase__InfluenzaA__BAD16645

SEQ ID NO: 209049 - RNA, 1410 nt, Artificial Sequence; identical to SEQ ID NO: 205568
  derived and/or modified sequence opt5 from neuraminidase__InfluenzaA__BAD16646

SEQ ID NO: 209050 - RNA, 1410 nt, Artificial Sequence; identical to SEQ ID NO: 197600
  derived and/or modified sequence opt5 from neuraminidase__InfluenzaA__BAD16647

SEQ ID NO: 209051 - RNA, 1410 nt, Artificial Sequence
  derived and/or modified sequence opt5 from neuraminidase__InfluenzaA__BAD16648
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacccccuaucgcacgcuccugaugaacgaacugggggugccuuuucaucucggaacaagacaggucuguaucgccugguccuccucuuccugccacgacggcaaggccuggcugcauguguguguuaccggcuacgauaaaaaugcuacagccagcuucauuuaugacgggcggcuuguggauucuaucggauccuggagcaagaacauucugcgcacccaggagucugaaugcgucuguaucuacgggaccugcacaguggugaugacggacggcuccgcuagcgagagagccgagaccaaaauccucuuuauugaagagggaaagaucguccacauuagcccccugucuggcagcgcgcaacacguugaagagugcuccuguuacccucgguaucccggggugcgcugcguguguagagauaauuggaagggaagcaaccggccggucguggacaucaauguuaaagauuacucuauuguguccagcuaugucugcucuggccuugugggcgacacaccucgcaagaacgacagaagcuccucuagcuacugucggaaccccaauaacgaaaaagggaaucauggaguuaagggcugggccuucgaugacgggaacgauguguggaugggacgcaccaucuccgaggagagcagaucuggcuaugaaacauuuaaagucaucgggggaugguccaccccuaauagcaagcugcagauuaacagacaggugaucgucgacucugauaaucgguccggcuacagcggcauuuucuccguggaggggaaaucuugcaucaaccgcuguuuuuauguugaacucauucggggaagagagcaggaaacgcgcgugugguggacaagcaauuccaucgucguguucugcggcaccucugggaccuacggaacaggcagcuggcccgacggggcugauauuaaccugaugcccaucuga

SEQ ID NO: 209052 - RNA, 1410 nt, Artificial Sequence
  derived and/or modified sequence opt5 from neuraminidase__InfluenzaA__BAE07203
augaaccccaaucagaagaucaccacaauuggcagcaucugcauggugauugggaucgucucccugaugcuccaaauuggaaacaucaucucuauuuggguuagccacuccauccagacgggcaaucagcaucaggccgagccuuguaaccaaucuauuaucaccuacgaaaauaacacaugggugaaucagaccuaugugaacauuagcaauacaaacuuccugaccgagaaagcugucgccuccgugacacuugcgggaaauucuagccugugcccgaucuccgggugggcuguuuacagcaaggacaacggcauuagaaucgggucuaaaggagauguguuugucauccgggaacccuucauuuccuguagccaccucgagugccgcaccuuuuuccugacgcagggcgcccuucugaaugacaagcauucuaacggcaccgugaaagauagauccccucaccggacacucaugagcugucccguuggggaagccccuucucccuauaauucccgcuuugagagcguggcuugguccgccucugcuugccaugacggaaccagcuggcugacaaucggcauuuccgggccugauaacggagccgucgcggugcugaaguacaacggcaucauuaccgacacgaucaagagcuggagaaauaacaucaugcggacacaggagucugaaugugccugcgugaauggguccuguuucaccgucaugacagauggaccgagcaacggccaagcuagcuauaaaauuuuucgcaucgagaagggcaaaguugugaagucugccgaacucaaugcucccaacuaccacuaugaggagugcuccuguuacccugacgccggggaaauuaccugcgugugcagagauaauuggcacggaucuaaccggcccugggucagcuucaaucagaaccuggaguaccgcaucggcuauauuuguuccgggguguuuggagacaauccuagacccaacgauggcaccgggagcugcggaccgguuucuccuaaaggcgcguacggcaucaagggguucuccuuuaaguauggaaauggcguguggaucgggcggacaaaaagcacgaacucucgcuccggauucgaaaugauuugggaccccaauggcuggaccgggacagauagcaacuuuuccgucaagcaggacaucguggccauuaccgacuggucuggcuacagcggauccuucguucagcauccugagcuuacaggccuggauuguaucagacccugcuucuggguggaacucauucgggggcgccccaaagagucuaccaucuggacgagcggauccagcauuucuuuuuguggcgucaacuccgacacagugggguggagcuggccugauggagcugagcugccguucaccaucgacaaguga

SEQ ID NO: 209053 - RNA, 1410 nt, Artificial Sequence
  derived and/or modified sequence opt5 from neuraminidase__InfluenzaA__BAF46322
augaaccccaauccuaagaucauuaccaucggcagcgugucccugacaauuucuacgaucugcuucuuuaugcagauugccauccucaucaccacagucacccugcacuucaaacaauacgaguuuaacagcccgcccaauaaccagguuaugcuuugugaaccuacaauuaucgagagaaauauuaccgaaaucguguaucugacaaacaccacgauugagaaggaaaucugccccaaacucgcugaguaccggaauugguccaagccucagugugacauuaccggguucgcccccuuuucuaaagauaacagcauccgccuguccgcgggaggcgacaucugggugacaagagagccuuaugucucuugcgauccggacaaguguuaccaguucgcucuugggcaaggaaccacacugaauaacgugcauagcaaugauaccguucacgaccggacgcccuaucgcacacuccugaugaacgaacugggcgugccuuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcagcacguggaagagugcuccugcuauccccgcuacccuggcgugagaugugucugccgggauaacuggaaagggagcaaccgccccaucguggacauuaauaucaaggacuacucuauuguuuccagcuauguguguucuggacuugucggcgauaccccgcggaaaaacgacagcuccucuagcucccauugccuggauccuaauaacgaagagggcgggcacggagugaagggcugggccuucgacgaugggaaugacguuuggaugggaagaacgaucagcgaaaaacuccgcucuggcuacgagacauuuaaggugaucgaggggugguccaaccccaauagcaaacugcaaauuaacagacaggucaucguggaucggggaaaucgcucuggcuauuccggcauuuucagcgucgaagggaaguccuguaucaacagaugcuuuuacguggagcugauucggggaagaaaggaagagaccgaaguucucuggaccucuaauagcaucguggucuucuguggcacauccgggaccuauggaacaggcucuuggccugacggggcugauauuaaccugaugcccaucuga

SEQ ID NO: 209054 - RNA, 1410 nt, Artificial Sequence; identical to SEQ ID NO: 197738
  derived and/or modified sequence opt5 from neuraminidase__InfluenzaA__BAF46323

SEQ ID NO: 209055 - RNA, 1410 nt, Artificial Sequence
  derived and/or modified sequence opt5 from neuraminidase__InfluenzaA__BAF46324
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauauuguucacgaccggaccccguaucgcacgcuccugaugaacgaacugggcgugcccuuucaucucgggacaaagcaggucugcaucgccugguccucuagcuccugucacgauggaaaagccuggcugcauguguggguuaccggcgacgauaagaaugcuacagccagcuucauuuacaacggcagacuuguggacucuaucgucuccuggagcaaaaagauucugcggacccaggagucugaaugcguguguaucaaugggaccugcacaguggucaugacggauggauccgcuagcggcaaagccgacaccaagauccucuuuauugaggaggggaagaucguucacacauccacccugucuggaagcgcgcaacacguggaagaguguuccugcuauccucgcuaccccggcgugagaugcgucugucgggauaacuggaaagggagcaaccgcccuauuguggacaucaauauuaaggacuacucuaucguuuccagcuaugugugcucuggacuugucggcgauacaccccggaaaaacgacagcuccucuagcucccauugucuggauccgaauaacgaagagggcgggcacggagugaagggcugggccuucgacgaugggaaugacguuuggaugggaagaaccaucagcgaaaaacuccgcucuggcuacgagacguuuaaggugauugaggggugguccaacccuaauagcaaacugcagaucaacagacaggucauuguggaucggggaaaucgcucuggcuauuccggcaucuucagcgucgaagggaaguccugcauuaacagauguuuuuacguggagcugauccggggaagaaaggaagagacagaaguucucuggaccucuaauagcauuguggucuucugcggcaccuccgggacauauggaaccggcucuuggcccgacggggcugauaucaaccugaugccuaucuga

SEQ ID NO: 209056 - RNA, 1410 nt, Artificial Sequence
  derived and/or modified sequence opt5 from neuraminidase__InfluenzaA__BAF46332
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaccacguggaggaaugcuccugcuauccuagauaccccggcgugcggugugucugccgcgacaacuggaaagggagcaacagaccuaucguggauauuaauaucaaggacuacucuauuguuuccagcuauguguguucuggacuugucggcgacacgccccggaaaaacgauagcuccucuagcucccauugccuggacccgaauaacgaggaaggcgggcacggagugaagggcugggccuucgaugacgggaaugauguuuggaugggacgcaccaucagcgagaaacucagaucuggcuacgagacauuuaaggugaucgaagggugguccaacccuaauagcaaacugcaaauuaaccggcaggucaucguggaccgcggaaauagaucuggcuauuccggcauuuucagcgucgaggggaaguccuguaucaaccggugcuuuuacguggaacugauuagaggacgcaaggaggaaaccgagguucucuggaccucuaauagcaucguggucuucuguggcacauccgggaccuauggaacaggcucuuggcccgauggggcugacauuaaccugaugccuaucuga

SEQ ID NO: 209057 - RNA, 1410 nt, Artificial Sequence
  derived and/or modified sequence opt5 from neuraminidase__InfluenzaA__BAF46334
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagauaccccggcgugcggugugucugccgcgacaacuggaaagggagcaacagaccuaucguggauauuaauaucaaggacuacucuauuguuuccagcuauguguguucuggacuugucggcgacacgccccggaaaaacgauagcuccucuagcucccacugccuggacccgaauaacgaggaaggcgggcauggagugaagggcugggccuucgaugacgggaaugauguuuggaugggacgcaccaucagcgagaaacucagaucuggcuacgagacauuuaaggugaucgaagggugguccaacccuaauagcaaacugcagauuaaccggcaggucaucguggaccgcggaaauagaucuggcuauuccggcauuuucagcgucgaggggaaguccuguaucaaccggugcuuuuacguggaacugauuagaggacgcaaggaggaaaccgagguucucuggaccucuaauagcaucguggucuucuguggcacauccgggaccuauggaacaggcucuuggcccgauggggcugacauuaaccugaugccuaucuga

SEQ ID NO: 209058 - RNA, 1410 nt, Artificial Sequence; identical to SEQ ID NO: 209057
  derived and/or modified sequence opt5 from neuraminidase__InfluenzaA__BAF46335

SEQ ID NO: 209059 - RNA, 1410 nt, Artificial Sequence
  derived and/or modified sequence opt5 from neuraminidase__InfluenzaA__BAF46337
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggugcgcacgccguauagaacacuccugaugaacgaacugggcguccccuuucaccucgggaccaaacaggugugcauugccugguccucuagcuccugucaugauggaaaggccuggcugcacguuugcgugacaggcgacgauaaaaaugcuaccgccagcuucaucuacaacggccggcuugucgacucuauuguguccuggagcaaggagauccugcgcacccaggaaucugagugugugugcauuaaugggacauguacggucguuaugaccgauggauccgcuagcggcaaagccgacacaaagauccucuuuaucgaggaagggaagauugugcauaccuccacacugucuggaagcgcgcaacacguggaggaaugcuccugcuauccuagauaccccggcguccggugugugugccgcgauaacuggaaagggagcaacagaccuaucguugacauuaauaucaaggauuacucuauuguguccagcuaugucuguucuggacuugugggcgacacgccccggaaaaacgacagcuccucuagcucccacugccuggauccgaauaacgaggaaggcgggcauggaguuaagggcugggccuucgacgaugggaaugacguguggauggcucgcaccaucagcgagaaacucagaucuggauacgagacauuuaaggucaucgaaggcugguccaacccuaauagcaaacugcagauuaaccgccaggugaucgucgaucgggggaauagaucuggauauuccggcauuuucagcguggagggcaaguccuguaucaaccggugcuuuuacguugaacugauuagagggcgcaaggaggaaaccgaggugcucuggaccucuaauagcaucgucguguucuguggaacauccggcaccuaugggacaggaucuuggcccgacggcgccgauauuaaccugaugccuaucuga

SEQ ID NO: 209060 - RNA, 1410 nt, Artificial Sequence; identical to SEQ ID NO: 209057
  derived and/or modified sequence opt5 from neuraminidase__InfluenzaA__BAF46345

SEQ ID NO: 209061 - RNA, 1410 nt, Artificial Sequence
  derived and/or modified sequence opt5 from neuraminidase__InfluenzaA__BAF46346
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauugccggguucgcgccuuuuucuaaggacaacagcauccgccuguccgcuggaggcgauaucugggugaccagagagcccuaugucucuugcgacccugauaaguguuaccaauucgcccuugggcagggaacaacccugaauaacgugcauagcaaugacacaguucgggaucgcaccccguauagaacgcuccugaugaacgaacugggcgugcccuuucaccucgggacaaaacaggucugcauugccugguccucuagcuccugucaugacggaaaggcuuggcugcacgugugcguuaccggcgaugacaaaaaugccacagcuagcuucaucuacaacggccggcuuguggauucuauugucuccuggagcaaggagauccugcgcacccaggaaucugagugugugugcauuaaugggaccuguacaguggucaugacggacggauccgccagcggcaaagcggauaccaagauccucuuuaucgaggaagggaagauuguucauacauccacccugucuggaagcgcccaacacguggaggaaugcuccugcuauccuagauaccccggcgugaucugugucugccgggacaacuggaaagggagcaaccgcccuauuguggauaucaauauuaaggacuacucuaucguuuccagcuauguguguucuggacuugucggcgacacaccccggaaaaacgauagcuccucuagcucccacugccuggacccgaauaacgaggaaggcgggcauggagugaagggcugggcuuucgaugacgggaaugauguuuggaugggaagaaccaucagcgagaaacuccgcucuggcuacgagacguuuaaggugauugaagggugguccaacccuaauagcaaacugcagaucaacagacaggucauuguggaccggggaaaucgcucuggcuauuccggcaucuucagcgucgaggggaaguccuguauuaacagaugcuuuuacguggaacugauccggggaagaaaggaggaaacagagguucucuggaccucuaauagcauuguggucuucuguggcaccuccgggacauauggaaccggcucuuggcccgauggggccgacaucaaccugaugccuaucuga

SEQ ID NO: 209062 - RNA, 1410 nt, Artificial Sequence
  derived and/or modified sequence opt5 from neuraminidase__InfluenzaA__BAF46347
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccagcagcuccugucaugacggaaaggccuggcugcacgugugcguuacaggcgaugacaaaaaugcuaccgccaccuucaucuacaacggccggcuuguggauagcauugucucuugguccaaggagauccugcgcacacaggaaagcgagugugugugcauuaaugggacguguaccguggucaugacagacggaucugcuuccggcaaagccgauaccaagauccucuuuaucgaggaagggaagauuguucauacaagcacccuguccggaucugcgcaacacguggaggaaugcagcugcuauccuagauaccccggcgugcggugugucugccgcgacaacuggaaaggguccaacagaccuaucguggauauuaauaucaaggacuacagcauuguuucuuccuauguguguagcggacuugucggcgacacgccccggaaaaacgauucuagcuccucuagccacugccuggacccgaauaacgaggaaggcgggcauggagugaagggcugggccuucgaugacgggaaugauguuuggaugggacgcacaaucuccgagaaacucagaagcggcuacgagaccuuuaaggugaucgaaggguggucuaacccuaauuccaaacugcagauuaaccggcaggucaucguggaccgcggaaauagaagcggcuauucuggcauuuucuccgucgaggggaagucuuguaucaaccggugcuuuuacguggaacugauuagaggacgcaaggaggaaaccgagguucucuggacauccaauucuaucguggucuucuguggcaccagcgggacauauggaacgggcuccuggcccgauggggcugacauuaaccugaugccuaucuga

SEQ ID NO: 209063 - RNA, 1410 nt, Artificial Sequence
  derived and/or modified sequence opt5 from neuraminidase__InfluenzaA__BAF46349
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggcccgcacgccguauagaacacuccugaugaacgaacugggcgugcccuuucaccucgggaccaaacaggucugcauugccugguccucuagcuccugucaugauggaaaggcuuggcugcacgugugcguuacaggcgacgauaaaaaugccaccgcuagcuucaucuacaacggccggcuuguggacucuauugucuccuggagcaaggagauccugcgcacccaggaaucugagugugugugcauuaaugggacauguacgguggucaugaccgauggauccgccagcggcaaagcggacacaaagauccucuuuaucgaggaagggaagauuguucauaccuccacacugucuggaagcgcccaacacguggaggaaugcuccugcuauccuagauaccccggcgugcggugugucugccgcgauaacuggaaagggagcaacagaccuaucguggacauuaauaucaaggauuacucuauuguuuccagcuauguguguucuggacuugucggcgacacgccccggaaaaacgacagcuccucuagcucccacugccuggauccgaauaacgaggaaggcgggcauggagugaagggcugggcuuucgacgaugggaaugacguuuggaugggacgcaccaucagcgagaaacucagaucuggcuacgagacauuuaagguguucgaagggugguccaacccuaauagcaaacugcagaucaaccggcaggucauuguggaucgcggaaauagaucuggcuauuccggcaucuuuagcgucgaggggaaguccuguauuaaccggugcuucuacguggaacugaucagaggacgcaaggaggaaaccgagguucucuggaccucuaauagcauuguggucuucuguggcacauccgggaccuauggaacaggcucuuggcccgacggggccgauaucaaccugaugccuauuuga

SEQ ID NO: 209064 - RNA, 1410 nt, Artificial Sequence; identical to SEQ ID NO: 209057
  derived and/or modified sequence opt5 from neuraminidase__InfluenzaA__BAF46350

SEQ ID NO: 209065 - RNA, 1410 nt, Artificial Sequence
  derived and/or modified sequence opt5 from neuraminidase__InfluenzaA__BAF46351
augaaccccauccagaagauuaucaccauuggcagcgugucccugacaaucucuacgauuugcuucuuuaugcaaaucgccauccucauuaccacagucacccugcacuucaaacaguacgaguuuaauagcccuccgaacaaucagguuaugcuuugugaacccacaaucauugagagaaacaucaccgaaauuguguaucugacaaauaccacgaucgagaaggaaauuugcccuaaacucgcugaguaccggaagugguccaaaccccaguguaacaucaccggguucgccccuuuuucuaaggacaauagcauccgccuguccgcgggaggcgauauuugggugacaagagagcccuaugucucuugcgacccugauaaguguuaccaauucgcucuugggcagggaaccacacugaacaaugugcauagcaacgacaccguucgggaucgcacgccguauagaacacuccugaugaaugaacugggcgugcccuuucaccucgggaccaaacaggucugcaucgccugguccucuagcuccugucaugacggaaaggccuggcugcacgugugcguuacaggcgaugacaaaaacgcuaccgccagcuucauuuacaauggccggcuuguggauucuaucgucuccuggagcaaggagauucugcgcacccaggaaucugagugugugugcaucaacgggacauguacgguggucaugaccgacggauccgcuagcggcaaagccgauacaaagauccucuuuauugaggaagggaagaucguucauaccuccacacugucuggaagcgcgcaacacguggaggaaugcuccugcuauccuagauaccccggcgugcggugugucugccgcgacaauuggaaagggagcaacagaccuaugguggauauuaacaucaaggacuacucuauuguuuccagcuauguguguucuggacuugucggcgacacgccccggaaaaaugauagcuccucuagcucccacugccuggacccgaacaaugaggaaggcgggcauggagugaagggcugggccuucgaugacgggaacgauguuuggaugggacgcaccaucagcgagaaacucagaucuggcuacgagacauuuaaggugaucgaagggugguccaauccuaacagcaaacugcagauuaaucggcaggucaucguggaccgcggaaacagaucuggcuauuccggcauuuucagcgucgaggggaaguccuguaucaaucggugcuuuuacguggaacugauuagaggacgcaaggaggaaaccgagguucucuggaccucuaacagcaucguggucuucuguggcacauccgggaccuauggaacaggcucuuggcccgauggggcugacauuaaucugaugccuaucuga

SEQ ID NO: 209066 - RNA, 1410 nt, Artificial Sequence
  derived and/or modified sequence opt5 from neuraminidase__InfluenzaA__BAF46368
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucgggaacgcacgccguauagaacacuccugaugaaugagcugggcgugcccuuucaccucgggaccaagcaggucugcauugccugguccucuagcuccugucaugauggaaaagccuggcugcacgugugcguuacaggcgacgauaagaacgcuaccgccagcuucaucuacaauggccggcuuguggacucuauugucuccuggagcaaagaaauccugcgcacccaggagucugagugugugugcauuaacgggacauguacgguggucaugaccgauggauccgcuagcggcaaggccgacacaaaaauccucuuuaucgaagaggggaagauuguucauaccuccacacugucuggaagcgcgcaacacguggaagagugcuccugcuauccuagauaccccggcgugcggugugucugccgcgauaacuggaaggggagcaauagaccuaucguggacauuaacaucaaagauuacucuauuguuuccagcuauguguguucuggacuugucggcgacacgccccggaagaaugacagcuccucuagcucccacugccuggauccgaacaaugaagagggcgggcauggagugaaaggcugggccuucgacgaugggaacgacguuuggaugggacgcaccaucagcgagaagcucagaucuggcuacgaaacauuuaaagugaucgaggggugguccaauccuaacagcaagcugcagauuaaucggcaggucaucguggaucgcggaaacagaucuggcuauuccggcauuuucagcgucgaagggaaauccuguaucaaucggugcuuuuacguggagcugauuagaggacgcaaggaagagaccgagguucucuggaccucuaacagcaucguggucuucuguggcacauccgggaccuauggaacaggcucuuggcccgacggggcugauauuaaucugaugccuaucuga

SEQ ID NO: 209067 - RNA, 1410 nt, Artificial Sequence
  derived and/or modified sequence opt5 from neuraminidase__InfluenzaA__BAF46369
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcaaacuuguggauucuauugucuccuggagcaaggagauccugagaacccaggaaucugagugugugugcauuaacgggacauguacgguggucaugaccgacggauccgcuagcggcaaagccgauacaaagauccucuuuaucgaggaagggaagauuguucacaccuccacacugucuggaagcgcgcaacacguggaggaaugcuccugcuauccucgguaccccggcgugcgcugugucugcagagacaacuggaaagggagcaaucggccuaucguggauauuaacaucaaggacuacucuauuguuuccagcuauguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucagcgagaaaucucgguccggcuacgagacauuucaggugaucgaaggguggagcaauucuaacuccaagcuccagauuaaucgccaggucaucguggacagaggaaaccggagcggcuauuccggcauuuucucugucgaggggaaaagcuguaucaaucgcugcuuuuacguggaacugauuagaggacggaaggaggaaaccgagguucuguggaccuccaacucuaucguggucuucuguggcacaagcgggaccuauggaacaggcuccuggccugauggggcugacauuaaucucaugcccaucuga

SEQ ID NO: 209068 - RNA, 1410 nt, Artificial Sequence
  derived and/or modified sequence opt5 from neuraminidase__InfluenzaA__BAF46370
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccaaacuggcugaguaccggaauugguccaagccucaguguaacauuaccggguucgcccccuuuucuaaagacaauagcauccgccuuuccgcgggaggcgauaucugggugacaagagagccuuaugucucuugcgaccccgauaaguguuaccaauucgcucuggggcagggaaccacacucaacaaugugcauagcaacgacaccguucacgaucggacgccuuaucgcacacugcugaugaaugaacucggcgugccguuucaucuggggaccaagcaggucugcauugccugguccucuagcuccugucacgacggaaaagccuggcuucaugugugcguuacaggcgaugacaagaacgcuaccgccagcuucaucuacaauggcagacugguggauucuauugucuccuggagcaaagagauccuccggacccaggaaucugagugugugugcauuaacgggacauguacgguggucaugaccgacggauccgcuagcggcaaggccgauacaaaaauccuguuuaucgaggaagggaagauuguucacaccuccacacuuucuggaagcgcgcaacacguggaggaaugcuccugcuauccccgcuacccuggcgugagaugugucugccgggacaacuggaaggggagcaaucgccccaucguggauauuaacaucaaagacuacucuauuguuuccagcuauguguguucuggacuggucggcgacaccccuagaaagaaugauagcuccucuagcucccauugccucgaccccaacaaugaggaaggcgggcacggagugaaaggcugggccuucgaugacgggaacgauguuuggaugggacggacgaucagcgagaagcugcgcucuggcuacgagacauuuaaagugaucgaagggugguccaauccgaacagcaagcugcagauuaauagacaggucaucguggaccggggaaaccgcucuggcuauuccggcauuuucagcgucgaggggaaauccuguaucaauagaugcuuuuacguggaacucauucggggaagaaaggaggaaaccgagguucuguggaccucuacaagcaucguggucuucuguggcuccucugggaccuauggaacaggcagcuggccugauggggcugacauuaaccuuaugcccaucuga

SEQ ID NO: 209069 - RNA, 1410 nt, Artificial Sequence
  derived and/or modified sequence opt5 from neuraminidase__InfluenzaA__BAF46371
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucgugcaucugacaaacaccacgauugagaaggaaaucugcccuaaacucgcugaguaucggaauugguccaagccccaguguaacauuaccggguucgccccuuuuucuaaagacaauagcauccgccuguccgcgggaggcgauaucugggugacaagagagcccuacgucucuugcgacccugauaaguguuaucaauucgcucuugggcagggaaccacacugaacaaugugcacagcaacgacaccguucaugaucggacgccguaccgcacacuccugaugaaugaacugggcgugcccuuucaccucgggaccaagcaggucugcauugccugguccucuagcuccugucaugacggaaaagccuggcugcacgugugcguuacaggcgaugacaagaacgcuaccgccagcuucaucuauaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacauguggaggaaugcuccugcuacccucgcuaucccggcgugagaugugucugccgggacaacuggaaggggagcaaucgcccuaucguggauauuaacaucaaagacuacucuauuguuuccagcuacguguguucuggacuugucggcgacacccccagaaagaaugauagcuccucuagcucccacugccuggacccgaacaaugaggaaggcgggcauggagugaaaggcugggccuucgaugacgggaacgauguuuggaugggacggacgaucagcgagaagcuccgcucuggcuaugagacauuuaaagugaucgaagggugguccaauccuaacagcaagcugcagaccaauagacaggucauuguggaccggucuaaccgcuccggauacagcggcaucuucuccgucgagggcaaaucuuguauuaauagaugcuuuuauguggaacugauccgggggagaaaggaggaaaccgagguucucuggacaagcaacuccauuguggucuucuguggaaccucuggcacauacgggacgggaagcuggcccgauggcgcugacaucaaucugaugccuauuuga

SEQ ID NO: 209070 - RNA, 1410 nt, Artificial Sequence
  derived and/or modified sequence opt5 from neuraminidase__InfluenzaA__BAF46372
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauugccggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaaugauacaguucacgaccggaccccguaucgcacgcuccugaugaacgaacugggcgugcccuuucaucucgggacaaagcaggucugcauugccugguccucuagcuccugucacgauggaaaggcuuggcugcaugugugcguuaccggcgacgauaaaaaugccacagcuagcuucaucuacaacggcagacuuguggacucuauugucuccuggagcaaaaagauccugcggacccaggagucugaaugugugugcauuaaugggaccuguacaguggucaugacggauggauccgccagcggcaaagcggacaccaagauccucuuuaucgaggaggggaagauuguucacacauccacccugucuggaagcgcccaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacaccccggaaaaacgacagcuccucuagcucccauugccuggauccgaauaacgaagagggcgggcacggagugaagggcugggcuuucgacgaugggaaugacguuuggaugggaagaaccaucagcgaaaaacuccgcucuggcuacgagacguuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagacagaaguucucuggaccucuaauagcaucguggucuucuguggcaccuccgggacauauggaaccggcucuuggcccgacggggccgauauuaaccugaugccuaucuga

SEQ ID NO: 209071 - RNA, 1410 nt, Artificial Sequence
  derived and/or modified sequence opt5 from neuraminidase__InfluenzaA__BAF46385
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccuguccugacggaaaagccuggcugcacgugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccccgcuacccuggcgccagaugugugugccgggacaacuggaaggggagcaaucgccccaucgucgauauuaacaucaaagacuacucuauuguguccagcuauguuuguucuggacuugugggcgacaccccgagaaagaaugauagcuccucuagcucccacugccuggacccuaacaaugaggaaggcgggcauggagucaaaggcugggcuuucgaugacgggaacgauguguggaugggacggacgaucagcgagaagcuccgcucuggcuacgagacauuuaaaguuaucgaagggugguccaaucccaacagcaagcugcagaccaauagacaggugauugucgaccggggaaaccgcucuggcuauuccggcaucuucagcguggaggggaaauccuguauuaauagaugcuuuuacgucgaacugauccggggaagaaaggaggaaaccgaggugcucuggacaucuaacagcauuguuguguucuguggcaccuccucuacauaugggacgggaagcuggccugauggcgccgacaucaaucugaugcccauuuga

SEQ ID NO: 209072 - RNA, 1410 nt, Artificial Sequence
  derived and/or modified sequence opt5 from neuraminidase__InfluenzaA__BAF46386
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagaccaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggacaucuaacagcauuguggucuucuguggcaccuccucuacauaugggacgggaagcuggcccgauggcgcugacaucaaucugaugccuauuuga

SEQ ID NO: 209073 - RNA, 1410 nt, Artificial Sequence; identical to SEQ ID NO: 199588
  derived and/or modified sequence opt5 from neuraminidase__InfluenzaA__BAF46387

SEQ ID NO: 209074 - RNA, 1410 nt, Artificial Sequence
  derived and/or modified sequence opt5 from neuraminidase__InfluenzaA__BAF46388
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggacaucgucgaucggggaaaccgcucuggcuauuccggcauuuucagcguggaggggaaauccuguaucaauagaugcuuuuacgucgaacugauucggggaagaaaggaggaaaacgaggugcucuggaccucuaauagcaucguuguguucuguggcaccuccgggacauauggaaccggcucuuggcccgacggggcugauauuaaccugaugccuaucuga

SEQ ID NO: 209075 - RNA, 1410 nt, Artificial Sequence
  derived and/or modified sequence opt5 from neuraminidase__InfluenzaA__BAF47922
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauauucagguuaugcuuugugaacccacaaucauugagagaaacaucaccgaaauuguguaucugacaaauaccacgaucgagaaggaaauuugcccuaaacucgcugaguaccggaacugguccaagccccagugugacaucaccggguucgccccuuuuucuaaagauaauagcauccgccuguccgcgggaggcgacauuugggugacaagagagcccuaugucucuugcgauccugacaaguguuaccaauucgcucuugggcagggaaccacacugaacaaugugcauagcaacgauaccguucacgaccggacgccguaucgcacacuccugaugaaugaacugggcgugcccuuucaucucgggaccaagcaggucugcaucgccugguccucuagcuccugucacgauggaaaagccuggcugcaugugugcguuacaggcgacgauaagaacgcuaccgccagcuucauuuacaauggcagacuuguggacucuaucgucuccuggagcaaagagauucugcggacccaggaaucugagugugugugcaucaacgggacauguacgguggucaugaccgauggauccgcuagcggcaaggccgacacaaaaauccucuuuauugaggaagggaagaucguucacaccuccacacugucuggaagcgcgcaacacguggaggaaugcuccugcuauccucgcuaccccggcgugagaugugucugccgggauaauuggaaggggagcaaccgcccuauuguggacaucaacauuaaagacuacucuaucgccuccagcuauguuuguucuggacuugugggcgauacccccagaaagaaugacagcuccucuagcucccauugccuggauccgaacaaugaggaaggcgggcacggagucaaaggcugggcuuucgacgaugggaacgacguguggaugggacggacgaucagcgagaagcuccgcucuggcuacgagacauuuaaaguuauugaagggugguccaauccuaacagcaagcugcagaucaauagacaggugauugucgaucggggaaaccgcucuggcuauuccggcaucuucagcguggaggggaaauccuguauuaauagaugcuuuuacgucgaacugauccggggaagaaaggaggaaaccgaggugcucuggaccucuaacagcauuguuguguucuguggcacauccgggaccuauggaacaggcucuuggcccgacggggccgauaucaaucugaugccuaucuga

SEQ ID NO: 209076 - RNA, 1410 nt, Artificial Sequence; identical to SEQ ID NO: 197718
  derived and/or modified sequence opt5 from neuraminidase__InfluenzaA__BAF47923

SEQ ID NO: 209077 - RNA, 1410 nt, Artificial Sequence
  derived and/or modified sequence opt5 from neuraminidase__InfluenzaA__BAF47924
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacagcgaggaaggcgggcacggagugaaaggcugggccuucgaugacgggaaugauguuuggaugggacggacgaucucugagaagcuccgcuccggcuacgagacauuuaaagugaucgaaggguggagcaacccuaauucuaagcugcagaccaacagacaggucauuguggaccggggaaaucgcuccggcuauagcggcaucuucuccgucgaggggaaaucuuguauuaacagaugcuuuuacguggaacugauccggggaagaaaggaggaaaccgagguucucuggacaagcaauuccauuguggucuucuguggcaccucugggacauauggaacgggcagcuggcccgauggggcugacaucaaccugaugccuauuuga

SEQ ID NO: 209078 - RNA, 1410 nt, Artificial Sequence; identical to SEQ ID NO: 197736
  derived and/or modified sequence opt5 from neuraminidase__InfluenzaA__BAF47925

SEQ ID NO: 209079 - RNA, 1410 nt, Artificial Sequence; identical to SEQ ID NO: 197736
  derived and/or modified sequence opt5 from neuraminidase__InfluenzaA__BAF47926

SEQ ID NO: 209080 - RNA, 1410 nt, Artificial Sequence; identical to SEQ ID NO: 203723
  derived and/or modified sequence opt5 from neuraminidase__InfluenzaA__BAF47927

SEQ ID NO: 209081 - RNA, 1410 nt, Artificial Sequence; identical to SEQ ID NO: 199588
  derived and/or modified sequence opt5 from neuraminidase__InfluenzaA__BAF47928

SEQ ID NO: 209082 - RNA, 1410 nt, Artificial Sequence
  derived and/or modified sequence opt5 from neuraminidase__InfluenzaA__BAF47929
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgaccgagaaggaaauuugcccuaaacucgcugaguaccggaauugguccaagccccaguguaacaucacaggguucgccccuuuuucuaaagacaauagcauucgccuguccgcgggaggcgauaucugggugaccagagagcccuaugucucuugcgacccugauaaguguuaccaauucgcucuugggcagggaacaacccugaacaaugugcauagcgacgauacgguucacgaccggacaccguaucgcacccuccugaugaacgaacugggcgugcccuuucaucucgggacaaagcaggucugcaucgccugguccucuagcuccugucacgauggaaaagccuggcugcaugugugcguuaccggcgacgauaagaaugcuaccgccagcuucauuuacaacggcagacuuguggacucuaucgucuccuggagcaaagagauucugcggacacaggaaucugagugugugugcaucaaugggacguguaccguggucaugacagauggauccgcuagcggcaaggccgacaccaaaauucucuuuaucgaggaagggaagaucguucacacauccacccugucuggaagcgcgcaacacguggaggaaugcuccugcuauccucgcuaccccggcgugagaugugucugccgggauaacuggaaggggagcaaccgcccuauuguggacaucaauauuaaagacuacucuaucguuuccagcuauguguguucuggacuugucggcgauacgcccagaaagaacgacagcuccucuagcucccauugccuggauccgaauaacgaggaaggcgggcacggagugaaaggcugggccuucgacgaugggaaugacguuuggaugggacggacaauuagcgagaagcuccgcucuggcuacgagaccuuuaaagugaucgaagggugguccaacccuaauagcaagcugcagaucaacagacaggucauuguggaucggggaaaucgcucuggcuauuccggcaucuucagcgucgaggggaaauccuguauuaacagaugcuuuuacguggaacugauccggggaagaaaggaggaaaaugagguucucuggaccucuaacagcauuguggucuucuguggcacauccgggaccuauggaacaggcucuuggcccgacggggcugauaucaaucugaugccuauuuga

SEQ ID NO: 209083 - RNA, 1410 nt, Artificial Sequence
  derived and/or modified sequence opt5 from neuraminidase__InfluenzaA__BAF47930
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacggccggacgccguaucgcacacuccugaugaaugaacugggggugcccuuucaucucggaaccaagcaggucugcauugccugguccucuagcuccugucacgauggcaaagccuggcugcaugugugcguuacaggcgacgauaagaacgcuaccgccagcuucaucuacaaugggagacuuguggacucuauugucuccuggagcaaagagauccugcggacccaggaaucugagugugugugcauuaacggaacauguacgguggucaugaccgauggcuccgcuagcgggaaggccgacacaaaaauccucuuuaucgaggaaggaaagauuguucacaccuccacacugucuggcagcgcgcaacacguggaggaaugcuccugcuauccucgcuaccccggggugagaugugucugccgggauaacuggaagggaagcaaucgcccuaucguggacauuaacaucaaagauuacucuaccguuuccagcuauguguguucuggccuugucggcgacacgcccagaaagaaugacagcuccucuagcgggcauugccuggauccgaacaaugaggaaggaggccacggggugaaaggaugggccuucgacgauggcaacgacguuuggauggggcggacaauuuccgagaagcuccgcagcggauacgagaccuuuaaagugaucgaaggcuggucuaauccuaacuccaagcugcagaucaauagacaggucauuguggaucggggcaaccgcagcggguauucuggaaucuucuccgucgagggcaaaagcuguauuaauagaugcuuuuacguggaacugauccgggggagaaaggaggaaaccgagguucucuggacauccaacucuauuguggucuucuguggaaccagcggcacauaugggacgggcuccuggcccgacggagcugauaucaaucugaugccuauuuga

SEQ ID NO: 209084 - RNA, 1410 nt, Artificial Sequence; identical to SEQ ID NO: 203723
  derived and/or modified sequence opt5 from neuraminidase__InfluenzaA__BAF47931

SEQ ID NO: 209085 - RNA, 1410 nt, Artificial Sequence
  derived and/or modified sequence opt5 from neuraminidase__InfluenzaA__BAF47932
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcggccauugccuggacccgaacaaugaggaagggggacacggcgugaaagggugggccuucgaugacggaaacgauguuuggaugggccggacgaucuccgagaagcuccgcagcggguacgagacauuuaaagugaucgaaggauggucuaauccuaacuccaagcugcagauuaauagacaggucaucguggaccggggcaaccgcagcggcuauucugggauuuucuccgucgagggaaaaagcuguaucaauagaugcuuuuacguggaacugauucggggcagaaaggaggaaaccgagguucucuggaccuccaacucuaucguggucuucugugggacaagcggaaccuauggcacaggguccuggcccgauggcgcugacauuaaucugaugccuaucuga

SEQ ID NO: 209086 - RNA, 1410 nt, Artificial Sequence; identical to SEQ ID NO: 197736
  derived and/or modified sequence opt5 from neuraminidase__InfluenzaA__BAF47933

SEQ ID NO: 209087 - RNA, 1410 nt, Artificial Sequence; identical to SEQ ID NO: 197738
  derived and/or modified sequence opt5 from neuraminidase__InfluenzaA__BAF47934

SEQ ID NO: 209088 - RNA, 1410 nt, Artificial Sequence; identical to SEQ ID NO: 197738
  derived and/or modified sequence opt5 from neuraminidase__InfluenzaA__BAF47935

SEQ ID NO: 209089 - RNA, 1410 nt, Artificial Sequence
  derived and/or modified sequence opt5 from neuraminidase__InfluenzaA__BAF47936
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcaucacaggcgaugacaagaacgcuaccgccagcuucauuuacaauggcagacuuguugauucuaucguguccuggagcaaagagauucugcggacccaggaaucugagugugucugcaucaacgggacauguacgguggugaugaccgacggauccgcuagcggcaaggccgauacaaaaauccucuuuauugaggaagggaagaucguccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcggccauugccuggacccgaacaaugaggaagggggacacggcgucaaagggugggccuucgaugacggaaacgauguguggaugggccggacgaucuccgagaagcuccgcagcggguacgagacauuuaaaguuauugaaggauggucuaauccuaacuccaagcugcagaucaauagacaggugauugucgaccggggcaaccgcagcggcuauucugggaucuucuccguggagggaaaaagcuguauuaauagaugcuuuuacgucgaacugauccggggcagaaaggaggaaaccgaggugcucuggaccuccaacucuauuguuguguucugugggacaagcggaaccuauggcacaggguccuggcccgauggcgcugacaucaaucugaugccuaucuga

SEQ ID NO: 209090 - RNA, 1410 nt, Artificial Sequence
  derived and/or modified sequence opt5 from neuraminidase__InfluenzaA__BAF47937
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgggccugacaaguguuaccaauucgcucuuggacagggcaccacacugaacaaugugcauagcaacgauaccguucacgaccggacgccguaucgcacacuccugaugaaugaacugggggugcccuuucaucucggaaccaagcaggucugcauugccugguccucuagcuccugucacgauggcaaagccuggcugcaugugugcguuacaggcgacgauaagaacgcuaccgccagcuucaucuacaaugggagacuuguggacucuauugucuccuggagcaaagagauccugcggacccaggaaucugagugugugugcauuaacggaacauguacgguggucaugaccgauggcuccgcuagcgggaaggccgacacaaaaauccucuuuaucgaggaaggaaagauuguucacaccuccacacugucuggcagcgcgcaacacguggaggaaugcuccugcuauccucgcuaccccggggugagaugugucugccgggauaacuggaagggaagcaaucgcccuaucguggacauuaacaucaaagauuacucuauuguuuccagcuauguguguucuggccuugucggcgacacccccagaaagaaugacagcuccucuagcucccauugccuggauccgaacaaugaggaagggggacacggcgugaaagggugggccuucgacgauggaaacgacguuuggaugggccggacgaucagcgagaagcuccgcucuggguacgagacauuuaaagugaucgaaggaugguccaauccuaacagcaagcugcagauuaauagacaggucaucguggaucggggcaaccgcucuggcuauuccgggauuuucagcgucgagggaaaauccuguaucaauagaugcuuuuacguggaacugauucggggcagaaaggaggaaaccgagguucucuggaccucuaacagcaucguggucuucugugggacauccggaaccuauggcacagggucuuggcccgacggcgcugauauuaaucugaugccuaucuga

SEQ ID NO: 209091 - RNA, 1410 nt, Artificial Sequence
  derived and/or modified sequence opt5 from neuraminidase__InfluenzaA__BAF47938
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccaaacuggcugaguaccggaauugguccaagccucaguguaacauuaccggguucgcccccuuuucuaaagacaauagcauccgccuuuccgcgggaggcgauaucugggugacaagagagccuuaugucucuugcgaccccgauaaguguuaccaauucgcucuggggcagggaaccacacucaacaaugugcauagcaacgacaccguucacggccggacgccuuaucgcacacugcugaugaaugaacucggggugccguuucaucugggaaccaagcaggucugcauugccugguccucuagcuccugucacgauggcaaagccuggcuucaugugugcguuacaggcgacgauaagaacgcuaccgccagcuucaucuacaaugggagacugguggacucuauugucuccuggagcaaagagauccuccggacccaggaaucugagugugugugcauuaacggaacauguacgguggucaugaccgauggcuccgcuagcgggaaggccgacacaaaaauccuguuuaucgaggaaggaaagauuguucacaccuccacacuuucuggcagcgcgcaacacguggaggaaugcuccugcuauccccgcuacccuggggugagaugugucugccgggauaacuggaagggaagcaaucgccccaucguggacauuaacaucaaagauuacucuauuguuuccagcuauguguguucuggccuggucggcgacaccccuagaaagacggacagcuccucuagcucccauugccucgaucccaauaacgaggaagggggacacggcgugaaagggugggccuucgacgauggaaaugacguuuggaugggccggacaaucagcgagaagcugcgcucuggguacgagaccuuuaaagugaucgaaggaugguccaacccgaauagcaagcugcagauuaacagacaggucaucguggaucggggcaaucgcucuggcuauuccgggauuuucagcgucgagggaaaauccuguaucaacagaugcuuuuacguggaacucauucggggcagaaaggaggaaaccgagguucuguggacaucuaauagcaucguggucuucugugggaccuccggaacauauggcacggggucuuggccugacggcgcugauauuaaccuuaugcccaucuga

SEQ ID NO: 209092 - RNA, 1410 nt, Artificial Sequence; identical to SEQ ID NO: 197738
  derived and/or modified sequence opt5 from neuraminidase__InfluenzaA__BAF47939

SEQ ID NO: 209093 - RNA, 1410 nt, Artificial Sequence
  derived and/or modified sequence opt5 from neuraminidase__InfluenzaA__BAF47940
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggagaaaaccgaaguucucuggaccucuaauagcaucguggucuucuguggcacauccgggaccuauggaacaggcucuuggcccgacggggcugauauuaaccugaugccuaucuga

SEQ ID NO: 209094 - RNA, 1410 nt, Artificial Sequence; identical to SEQ ID NO: 197736
  derived and/or modified sequence opt5 from neuraminidase__InfluenzaA__BAF47941

SEQ ID NO: 209095 - RNA, 1410 nt, Artificial Sequence
  derived and/or modified sequence opt5 from neuraminidase__InfluenzaA__BAF47943
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugauugaacugggcgugcccuuucaucucgggaccaagcaggucugcaucgccugguccucuagcuccugucacgacggaaaagccuggcugcaugugugcguuacaggcgaugacaagaaugcuaccgccagcuucauuuacaacggcagacuuguggauucuaucgucuccuggagcaaagagauucugcggacccaggaaucugagugugugugcaucaaugggacauguacgguggucaugaccgacggauccgcuagcggcaaggccgauacaaaaauccucuuuauugaggaagggaagaucguucacaccuccacacugucuggaagcgcgcaacacguggaggaaugcuccugcuauccucgcuaccccggcgugagaugugucugccgggacaacuggaaggggagcaaccgcccuauuguggauaucaauauuaaagacuacucuaucguuuccagcuauguguguucuggacuugucggcgacacccccagaaagaacgauagcuccucuagcucccauugccuggacccgaauaacgaggaaggcgggcacggagugaaaggcugggccuucgaugacgggaaugauguuuggaugggacggacgaucagcgagaagcuccgcucuggcuacgagacauuuaaagugauugaagggugguccaacccuaauagcaagcugcagaccaacagacaggucaucguggaccggggaaaucgcucuggcuauuccggcauuuucagcgucgaggggaaauccuguaucaacagaugcuuuuacguggaacugauucggggaagaaaggaggaaaccgagguucucuggacaucuaauagcaucguggucuucuguggcaccuccgggacauauggaacgggcucuuggcccgauggggcugacauuaaccugaugccuaucuga

SEQ ID NO: 209096 - RNA, 1410 nt, Artificial Sequence
  derived and/or modified sequence opt5 from neuraminidase__InfluenzaA__BAF47944
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucaccgaguaccggaauugguccaagccccaguguaacauuacaggguucgcuccuuuuucuaaagacaauagcauccgccuguccgccggaggcgauaucugggugaccagagagcccuaugucucuugcgacccugauaaguguuaccaauucgcgcuugggcagggaacaacccugaacaaugugcauagcaacgacccgguucacgaucggacgcccuaucgcacacuccugaugaaugaacugggcgugccuuuucaucucgggaccaagcaggucugcauugcuugguccucuagcuccugucacgacggaaaagccuggcugcaugugugcguuacaggcgaugacaagaacgccaccgcuagcuucaucuacaauggcagacuuguggauucuauugucuccuggagcaaagagauccugcggacccaggaaucugagugugugugcauuaacgggacauguacgguggucaugaccgacggauccgccagcggcaaggcugauacaaaaauccucuuuaucgaggaagggaagauuguucacaccuccacacugucuggaagcgcccaacacguggaggaaugcuccugcuauccccgcuacccuggcgugagaugugucugccgggacaacuggaaggggagcaaucgccccaucguggauauuaacaucaaagacuacucuauuguuuccagcuauguguguucuggacuugucggcgacaccccgagaaagaaugauagcuccucuagcucccauugccuggacccuaacaaugaggaaggcgggcacggagugaaaggcugggcguucgaugacgggaacgauguuuggaugggacggacgaucagcgagaagcuccgcucuggcuacgagacauuuaaagugaucgaagggugguccaaucccaacagcaagcugcagaccaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggacaucuaacagcauuguggucuucuguggcaccuccgggacauauggaacgggcucuuggccugauggggccgacaucaaucugaugcccauuuga

SEQ ID NO: 209097 - RNA, 1410 nt, Artificial Sequence
  derived and/or modified sequence opt5 from neuraminidase__InfluenzaA__BAF47945
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaaacuuugugaacccacaauuaucgagagaaauauuaccgaaaucguguaucugacaaacaccacgauugagaaagaaaucugcccuaagcucgcugaguaccggaauugguccaaaccccaguguaacauuaccggguucgccccuuuuucuaaggacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaaacaggucugcauugccugguccucuagcuccugucacgacggaaaggccuggcugcaugugugcguuacaggcgaugacaaaaacgcuaccgccagcuucaucuacaauggcagacuuguggauucuauugucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucacaccuccacacugucuggaagcgcgcaacacguggaggaaugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgaucagcgagaaacuccgcucuggcuacgagacauuuaaggugaucgaagggugguccaauccuaacagcaaacugcagaccaauagacaggucauuguggaccggggaaaccgcucuggcuauuccggcaucuucagcgucgaggggaaguccuguauuaauagaugcuuuuacguggaacugauccggggaagaaaggaggaaaccgagguucucuggacaucuaacagcauuguggucuucuguggcaccuccgggacauauggaacgggcucuuggcccgauggggcugacaucaaucugaugccuauuuga

SEQ ID NO: 209098 - RNA, 1410 nt, Artificial Sequence
  derived and/or modified sequence opt5 from neuraminidase__InfluenzaA__BAF47946
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugcuggaagggugguccaauccuaacagcaagcugcagaccaauagacaggucaucguggaccggggaaaccgcucuggcuauuccggcauuuucagcgucgaggggaaauccuguaucaauagaugcuuuuacguggaacucauucggggaagaaaggaggaaaccgagguucuguggacaucuaacagcaucguggucuucuguggcaccuccgggacauauggaacgggcucuuggcccgauggggcugacauuaaucuuaugccuaucuga

SEQ ID NO: 209099 - RNA, 1410 nt, Artificial Sequence
  derived and/or modified sequence opt5 from neuraminidase__InfluenzaA__BAF47948
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaagguucacgaccggaccccguaucgcacgcuccugaugaacgaacugggcgugcccuuucaucucgggacaaaacaggucugcauugccugguccucuagcuccugucacgauggaaaggccuggcugcaugugugcguuaccggcgacgauaaaaaugcuacagccagcuucaucuacaacggcagacuuguggacucuauugucuccuggagcaagaaaauccugcggacccaggagucugaaugugugugcauuaaugggaccuguacaguggucaugacggauggauccgcuagcggcaaggccgacaccaagauccucuuuaucgaggaggggaaaauuguucacacauccacccugucuggaagcgcgcaacacguggaagagugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacacccagaaagaacgacagcuccucuagcucccauugccuggauccgaauaacgaagagggcgggcacggagugaaaggcugggccuucgacgaugggaaugacguuuggaugggacggaccaucagcgaaaagcuccgcucuggcuacgagacguuuaaagugaucgaggggugguccaacagcaauucuaagcugcagauuaacagacaggucaucguggaucggggaaaucgcuccggcuauagcggcauuuucuccgucgaagggaagucuuguaucaacagaugcuuuuacguggagcugauucggggaagaaaagaagagacagaaguucucuggaccagcaauuccaucguggucuucuguggcaccucugggacauauggaaccggcagcuggccugacggggcugauauuaaccugaugcccaucuga

SEQ ID NO: 209100 - RNA, 1410 nt, Artificial Sequence
  derived and/or modified sequence opt5 from neuraminidase__InfluenzaA__BAF47949
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaagguucacgaccggaccccguaucgcacgcuccugaugaacgaacugggcgugcccuuucaucucgggacaaaacaggucugcauugccugguccucuagcuccugucacgauggaaaggccuggcugcaugugugcguuaccggcgacgauaaaaaugcuacagccagcuucaucuacaacggcagacuuguggacucuauugucuccuggagcaagaaaauccugcggacccaggagucugaaugugugugcauuaaugggaccuguacaguggucaugacggauggauccgcuagcggcaaggccgacaccaagauccucuuuaucgaggaggggaaaauuguucacacauccacccugucuggaagcgcgcaacacguggaagagugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacacccagaaagaacgacagcuccucuagcucccauugccuggauccgaauaacgaagagggcgggcacggagugaaaggcugggccuucgacgaugggaaugacguuuggaugggacggaccaucagcgaaaagcuccgcucuggcuacgagacguuuaaagugaucgaggggugguccaacccuaauagcaagcugcagauuaacagacaggucaucguggaucggggaaaucgcucuggcuauuccggcauuuucagcgucgaagggaaguccuguaucaacagaugcuuuuacguggagcugauucggggaagaaaagaagagacagaaguucucuggaccucuaauagcaucguggucuucuguggcaccuccgggacauauggaaccggcucuuggcccgacggggcugauauuaaccugaugccuaucuga

SEQ ID NO: 209101 - RNA, 1410 nt, Artificial Sequence; identical to SEQ ID NO: 197738
  derived and/or modified sequence opt5 from neuraminidase__InfluenzaA__BAF47950

SEQ ID NO: 209102 - RNA, 1410 nt, Artificial Sequence
  derived and/or modified sequence opt5 from neuraminidase__InfluenzaA__BAF47951
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacagcaauucuaaacugcagauuaacagacaggucaucguggaucggggaaaucgcuccggcuauagcggcauuuucuccgucgaagggaagucuuguaucaacagaugcuuuuacguggagcugauucggggaagaaaggaagagaccgaaguucucuggaccagcaauuccaucguggucuucuguggcacaucugggaccuauggaacaggcagcuggccugacggggcugauauuaaccugaugcccaucuga

SEQ ID NO: 209103 - RNA, 1410 nt, Artificial Sequence
  derived and/or modified sequence opt5 from neuraminidase__InfluenzaA__BAF47952
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagaccaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggacaucuaacagcauuguggucuucuguggcaccuccgggacauauggaacgggcucuuggcccgauggggcuaauaucaaccugaugccuauuuga

SEQ ID NO: 209104 - RNA, 1410 nt, Artificial Sequence
  derived and/or modified sequence opt5 from neuraminidase__InfluenzaA__BAF47953
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgaugagaaugcuaccgccagcuucaucuacaacggcagacuuguggacucuauugucuccuggagcaagaaaauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 209105 - RNA, 1410 nt, Artificial Sequence; identical to SEQ ID NO: 209057
  derived and/or modified sequence opt5 from neuraminidase__InfluenzaA__BAF47954

SEQ ID NO: 209106 - RNA, 1410 nt, Artificial Sequence; identical to SEQ ID NO: 209057
  derived and/or modified sequence opt5 from neuraminidase__InfluenzaA__BAF47955

SEQ ID NO: 209107 - RNA, 1410 nt, Artificial Sequence
  derived and/or modified sequence opt5 from neuraminidase__InfluenzaA__BAF47956
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagauaccccggcgugcggugugucugccgcgacaacuggaaagggagcaacagaccuaucguggauauuaauaucaaggacuacucuauuguuuccagcuauguguguucuggacuugucggcgacacgccccggaaaaacgauagcuccucuagcucccacugccuggacccgaauaacgaggaaggcgggcauggagugaagggcugggccuucgaugacgggaaugauguuuggaugggacgcaccaucagcgagaaacucagaucuggcuacgagacauuuaaggugaucgaagggugguccaacccuaauagcaaacugcagauuaaccggcaggucaucguggaccgcggaaauagaucuggcuauuccggcauuuucagcgucgaggggaaguccuguaucaaccggugcuuuuacguggaacugauuagaggacgcaaggaggaaaccgagguucucuggaccucuaauagcaucguggucuucuguggcacauccgggaccuauggaacaggcucuuggcccgauggggcugacauuaacuucaugccuaucuga

SEQ ID NO: 209108 - RNA, 1410 nt, Artificial Sequence
  derived and/or modified sequence opt5 from neuraminidase__InfluenzaA__BAF47958
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacucaugaugaacgaacugggcgugcccuuucaccuggggaccaaacaggucugcauugccugguccucuagcuccugucaugacggaaaggccuggcuccacgugugcguuacaggcgaugacaaaaaugcuaccgccagcuucaucuacaacggccggcugguggauucuauugucuccuggagcaaggagauccuucgcacccaggaaucugagugugugugcauuaaugggacauguacgguggucaugaccgacggauccgcuagcggcaaagccgauacaaagauccuguuuaucgaggaagggaagauuguucauaccuccacacucucuggaagcgcgcaacacguggaggaaugcuccugcuauccuagauaccccggcgugcggugugucugccgcgacaacuggaaagggagcaacagaccuaucguggauauuaauaucaaggacuacucuauuguuuccagcuauguguguucuggacuggucggcgacacgccccggaaaaacgauagcuccucuagcucccacugccuugacccgaauaacgaggaaggcgggcauggagugaagggcugggccuucgaugacgggaaugauguuuggaugggacgcaccaucagcgagaaacugagaucuggcuacgagacauuuaaggugaucgaagggugguccaacccuaauagcaaacuccagauuaaccggcaggucaucguggaccgcggaaauagaucuggcuauuccggcauuuucagcgucgaggggaaguccuguaucaaccggugcuuuuacguggaacugauuagaggacgcaaggaggaaaccgagguucuguggaccucuaauagcaucguggucuucuguggcacauccgggaccuauggaacaggcucuuggacggauggggcugacauuaacuucaugcccaucuga

SEQ ID NO: 209109 - RNA, 1410 nt, Artificial Sequence
  derived and/or modified sequence opt5 from neuraminidase__InfluenzaA__BAF47959
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacuauaccguucacgaccggacgccguaccgcacacuccugaugaaugaacugggcgugcccuuucaucucgggaccaagcaggucugcauugccugguccucuagcuccugucacgauggaaaagccuggcugcaugugugcguuacaggcgacgauaagaacgcuaccgccagcuucaucuauaauggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuacccucgcuaccccggcgugagaugugucugccgggauaacuggaaggggagcaaucgcccuaucguggacauuaacaucaaagauuauucuauuguuuccagcuacguguguucuggacuugucggcgacacccccagaaagaaugacagcuccucuagcggccauugccuggauccgaacaaugaggaagggggacacggcgugaaagggugggccuucgacgauggaaacgacguuuggaugggccggacgaucuccgagaagcuccgcagcggguaugagacauuuaaagugaucgaaggauggucuaauccuaacuccaagcugcagauuaauagacaggucaucguggaucggggcaaccgcagcggcuacucugggauuuucuccgucgagggaaaaagcuguaucaauagaugcuuuuauguggaacugauucggggcagaaaggaggaaaccgagguucucuggaccuccaacucuaucguggucuucugugggacaagcggaaccuacggcacaggguccuggcccgacggcgcugauauuaaucugaugccuaucuga

SEQ ID NO: 209110 - RNA, 1410 nt, Artificial Sequence
  derived and/or modified sequence opt5 from neuraminidase__InfluenzaA__BAF47960
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacaaucggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaauuggaaggggagcaaccgcccuaucguggacauuaauaucaaagauuacucuauuguuuccagcuauguguguucuggacuugucggcgacacccccagaaagaacgacagcuccucuagcggccauugccuggauccgaauaacgaggaagggggacacggcgugaaagggugggccuucgacgauggaaaugacguuuggaugggccggacgaucuccgagaagcuccgcagcggguacgagacauuuaaagugaucgaaggauggucuaacccuaauuccaagcugcagauuaacagacaggucaucguggaucggggcaaucgcagcggcuauucugggauuuucuccgucgagggaaaaagcuguaucaacagaugcuuuuacguggaacugauucggggcagaaaggaggaaaccgagguucucuggaccuccaauucuaucguggucuucugugggacaagcggaaccuauggcacaggguccuggcccgacggcgcugauauuaaccugaugccuaucuga

SEQ ID NO: 209111 - RNA, 1410 nt, Artificial Sequence
  derived and/or modified sequence opt5 from neuraminidase__InfluenzaA__BAF47975
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagauaccccggcgugcggugugucugccgcgacaacuggaaagggagcaacagaccuaucguggauauuaauaucaaggacuacucuauuguuuccagcuauguguguucuggacuugucggcgacacgccccggaaaaacgauagcuccucuagcucccacugccuggacccgaauaacgaggaaggcgggcauggagugaagggcugggccuucgaugacgggaaugauguuuggaugggacgcaccaucagcgagaaacucagaucuggcuacgagacauuuaaggugaucgaagggugguccaacccuaauagcaaacugcagauuaaccggcaggucaucguggaccgcggaaauagaucuggcuauuccggcauuuucagcgucgaggggaaguccuguaucaaccggugcuuuuacguggaacugauuagaggacgcaaggaggaaaccgagguucucuggaccucuaauagcaucguggucuucuguggcacauccgggaccuauggaacaggcucuuggcccgauggggcugacauuaaccacaugccuaucuga

SEQ ID NO: 209112 - RNA, 1410 nt, Artificial Sequence; identical to SEQ ID NO: 197736
  derived and/or modified sequence opt5 from neuraminidase__InfluenzaA__BAF47976

SEQ ID NO: 209113 - RNA, 1410 nt, Artificial Sequence
  derived and/or modified sequence opt5 from neuraminidase__InfluenzaA__BAF47977
augaaccccaaucagaagaucauuaccaucggcagcgugucccugacaauuucuacgaucugcuucuuuaugcaaauugccauccucaucaccacagucacccugcaguucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaauguaacauuaccggguucgccccuuuuucuaaagacaauagcauccgccuguccgcgggaggcgauaucugggugacaagagagcccuaugucucuugcgacccugauaaguguuaccaguucgcucuugggcagggaaccacacugaacaaugugcacagcaacgacaccguucauggccggacgccguaucgcacacuccugaugaaugaacugggggugcccuuucaccucggaaccaagcaggucugcauugccugguccucuagcuccugucaugauggcaaagccuggcugcacgugugcguuacaggcgacgauaagaacgcuaccgccagcuucaucuacaaugggagacuuguggacucuauugucuccuggagcaaagagauccugcggacccaagaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcagcacguggaggaaugcuccugcuauccucgcuaccccggggugagaugugucugccgggauaacuggaagggaagcaaucgcccuaucguggacauuaacaucaaagauuacucuauuguuuccagcuauguguguucuggccuugucggcgacacccccagaaagaaugacagcuccucuagcucccacugccuggauccgaacaaugaggaagggggacauggcgugaaagggugggccuucgacgauggaaacgacguuuggaugggccggacgaucagcgagaagcuccgcucuggguacgagacauuuaaagugaucgaaggaugguccaauccuaacagcaagcugcagaccaauagacaggucauuguggaucggggcaaccgcucuggcuauuccgggaucuucagcgucgagggaaaauccuguauuaauagaugcuuuuacguggaacugauccggggcagaaaggaggaaaccgagguucucuggacaucuaacagcauuguggucuucugugggaccuccggaacauauggcacggggucuuggcccgacggcgcugauaucaaucugaugccuauuuga

SEQ ID NO: 209114 - RNA, 1410 nt, Artificial Sequence
  derived and/or modified sequence opt5 from neuraminidase__InfluenzaA__BAF47978
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccaguguaacaucaccggguucgccccuuuuucuaaagacaauagcauucgccuguccgcgggaggcgauaucugggucacaagagagcccuaugugucuugcgacccugauaaguguuaccaauucgcucuugggcagggaaccacacugaacaauguucauagcaacgacaccgugcacgaucggacgccguaucgcacacuccugaugaaugaacugggcguccccuuucaucucgggaccaaacaggugugcaucgccugguccucuagcuccugucacgacggaaaggccuggcugcauguuugcgugacaggcgaugacaagaacgcuaccgccagcuucauuuacaauggcagacuugucgauucuaucguguccuggagcaaagagauucugcggacccaggaaucugagugugugugcaucaacgggacauguacggucguuaugaccgacggauccgcuagcggcaaggccgauacaaaaauucucuuuaucgaggaagggaagaucgugcacaccuccacacugucuggaagcgcgcaacacguggaggaaugcuccugcuauccucgcuaccccggcgucagaugugugugccgggacaacuggaaggggagcaaucgcccuauuguugauaucaacauuaaagacuacucuaucguguccagcuaugucuguucuggacuugugggcgacacccccagaaagaaugauagcuccucuagcucccauugccuggacccgaacaaugaggaaggcgggcacggaguuaaaggcugggccuucgaugacgggaacgaugcuuggaugggacggacgauuagcgagaagcuccgcucuggcuacgagacauuuaaagugaucgaagggugguccaauccuaacagcaagcugcagaucaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggaccucuaacagcauuguggucuucuguggcacauccgggaccuauggaacaggcucuuggcccgauggggccgacaucaaucugaugccuauuuga

SEQ ID NO: 209115 - RNA, 1410 nt, Artificial Sequence
  derived and/or modified sequence opt5 from neuraminidase__InfluenzaA__BAF47979
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacaaucggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaauuggaaggggagcaaccgcccuaucguggacauuaauaucaaagauuacucuauuguuuccagcuauguguguucuggacuugucggcgacacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagaccaacagacaggucauuguggaucggggaaaucgcucuggcuauuccggcaucuucagcgucgaggggaaauccuguauuaacagaugcuuuuacguggaacugauccggggaagaaaggaggaaaccgagguucucuggacaucuaauagcauuguggucuucuguggcaccuccgggacauauggaacgggcucuuggcccgacggggcugauaucaaccugaugccuauuuga

SEQ ID NO: 209116 - RNA, 1410 nt, Artificial Sequence; identical to SEQ ID NO: 199588
  derived and/or modified sequence opt5 from neuraminidase__InfluenzaA__BAF47980

SEQ ID NO: 209117 - RNA, 1410 nt, Artificial Sequence
  derived and/or modified sequence opt5 from neuraminidase__InfluenzaA__BAF47981
augaaccccaaucagaagaucauuaccaucggcagcgugucccugacaauuucuacgaucugccucuucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccggaagugguccaaaccccaguguaauauuaccggguuugccccuuucucuaaggacaacagcauccgccuuuccgcgggaggcgauaucugggugacaagagagcccuaugucucuugcgacccugauaaguguuaccaauuugcucuggggcagggaaccacacucaauaacgugcauagcaaugacaccguucggaaccgcacgccguauagaacacugcugaugaaugaacucggcgugcccuuccaccuggggaccaaacaggucugcauugccugguccucuagcuccugucaugauggaaaggccuggcuucacgugugcguuacaggcgacgauaaaaacgcuaccgccagcuuuaucuacaauggccggcugguggacucuauugucuccuggagcaaggagauccuccgcacccaggaaucugagugugugugcauuaacgggacauguacgguggucaugaccgauggauccgcuagcggcaaagccgacacaaagauccuguucaucgaggaagggaagauuguucauaccuccacacuuucuggaagcgcgcaacacguggaggaaugcuccugcuauccuagauaccccggcgugcggugugucugccgcgauaacuggaaagggagcaauagaccuaucguggacauuaacaucaaggauuacucuauuguuuccagcuauguguguucuggacuggucggcgacacgccccggaaaaaugacagcuccucuagcucccacugccucgauccgaacaaugaggaaggcgggcauggagugaagggcugggccuuugacgaugggaacgacguuuggaugggacgcaccaucagcgagaaacugagaucuggcuacgagacauucaaggugaucgaagggugguccaauccuaacagcaaacugcagauuaaucggcaggucaucguggaucgcggaaacagaucuggcuauuccggcauuuuuagcgucgaggggaaguccuguaucaaucggugcuucuacguggaacucauuagaggacgcaaggaggaaaccgagguucuguggaccucuaacagcaucguggucuuuuguggcacauccgggaccuauggaacaggcucuuggcccgacggggcugauauuaaucuuaugccuaucuga

SEQ ID NO: 209118 - RNA, 1410 nt, Artificial Sequence
  derived and/or modified sequence opt5 from neuraminidase__InfluenzaA__BAF47982
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucggaaccgcacgccguauagaacacuccugaugaaugaacugggcgugcccuuucaccucgggaccaaacaggucugcauugccugguccucuagcuccugucaugauggaaaggccuggcugcacgugugcguuacaggcgacgauaaaaacgcuaccgccagcuucaucuacaauggccggcuuguggacucuauugucuccuggagcaaggagauccugcgcacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccuagauaccccggcgugcggugugucugccgcgauaacuggaaagggagcaauagaccuaucguggacauuaacaucaaggauuacucuauuguuuccagcuauguguguucuggacuugucggcgacacgccccggaaaaaugacagcuccucuagcucccacugccuggauccgaacaaugaggaaggcgggcauggagugaagggcugggccuucgacgaugggaacgacguuuggaugggacgcaccaucagcgagaaacucagaucuggcuacgagacauuuaaggugaucgaagggugguccaauccuaacagcaaacugcagauuaaucggcaggucaucguggaucgcggaaacagaucuggcuauuccggcauuuucagcgucgaggggaaguccuguaucaaucggugcuuuuacguggaacugauuagaggacgcaaggaggaaaccgagguucucuggaccucuaacagcaucguggucuucuguggcacauccgggaccuauggaacaggcucuuggcccgacggggcugauauuaaucugaugccuaucuga

SEQ ID NO: 209119 - RNA, 1410 nt, Artificial Sequence; identical to SEQ ID NO: 199588
  derived and/or modified sequence opt5 from neuraminidase__InfluenzaA__BAF47983

SEQ ID NO: 209120 - RNA, 1410 nt, Artificial Sequence
  derived and/or modified sequence opt5 from neuraminidase__InfluenzaA__BAF47984
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacggccggacgccguaucgcacacuccugaugaaugaacugggggugcccuuucaucucggaaccaagcaggucugcauugccugguccucuagcuccugucacgauggcaaagccuggcugcaugugugcguuacaggcgacgauaagaacgcuaccgccagcuucaucuacaaugggagacuuguggacucuauugucuccuggagcaaagagauccugcggacccaggaaucugagugugugugcauuaacggaacauguacgguggucaugaccgauggcuccgcuagcgggaaggccgacacaaaaauccucuuuaucgaggaaggaaagauuguucacaccuccacacugucuggcagcgcgcaacacguggaggaaugcuccugcuauccucgcuaccccggggugagaugugucugccgggauaacuggaagggaagcaaucgcccuaucguggacauuaacaucaaagauuacucuauuguuuccagcuauguguguucuggccuugucggcgacacccccagaaagaaugacagcuccucuagcucccauugccuggauccgaacaaugaggaaggggaccacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucucuggaccucuaacagcaucguggucuucuguggcacauccgggaccuauggaacaggcucuuggcccgauggggcugacauuaaucugaugccuaucuga

SEQ ID NO: 209121 - RNA, 1410 nt, Artificial Sequence
  derived and/or modified sequence opt5 from neuraminidase__InfluenzaA__BAF47985
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacucgcugaguaccggaauuggagcaagccccagugugacauuaccggguuugccccuuucuccaaagauaacucuauccgccugagcgcgggaggcgacaucugggugacaagagagcccuaugucuccugcgauccugacaaguguuaccaauuugcucuugggcagggaaccacacugaauaacgugcauucuaaugauaccguucacgaccggacgccguaucgcacacuccugaugaacgaacugggcgugcccuuccaucucgggaccaagcaggucugcauugccuggagcuccagcucuugucacgauggaaaagccuggcugcaugugugcguuacaggcgacgauaagaaugcuaccgccuccuuuaucuacaacggcagacuuguggacagcauugucucuugguccaaaaagauccugcggacccaggagagcgaaugugugugcauuaaugggacauguacgguggucaugaccgauggaucugcuuccggcaaagccgacacaaagauccucuucaucgaggaggggaagauuguucacaccagcacacuguccggaucugcgcaacacguggaagagugcagcugcuauccucgcuaccccggcgugagaugugucugccgggauaacuggaaaggguccaaccgcccuaucguggacauuaauaucaaggacuacagcauuguuucuuccuauguguguagcggacuugucggcgauacccccagaaagaacgacucuagcuccucuagccauugccuggauccgaauaacgaagagggcgggcacggagugaagggcugggccuuugacgaugggaaugacguuuggaugggacggacgaucuccgaaaaacuccgcagcggcuacgagacauucaaggugaucgagggguggucuaacccuaauuccaaacugcagauuaacagacaggucaucguggaucggggaaaucgcagcggcuauucuggcaucuuuuccgucgaagggaaaagcuguauuaacagaugcuucuacguggagcugauucggggaagaaaggaagagaccgaaguucucuggaccuccaauucuaucguggucuucuguggcacaagcgggaccuauggaacaggcuccuggcccgacggggcugauauuaaccugaugccuaucuga

SEQ ID NO: 209122 - RNA, 1410 nt, Artificial Sequence
  derived and/or modified sequence opt5 from neuraminidase__InfluenzaA__BAF47986
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacucgcugaguaccggaauuggagcaagccccagugugacauuaccggguuugccccuuucuccaaagauaacucuauccgccugagcgcgggaggcgacaucugggugacaagagagcccuaugucuccugcgauccugacaaguguuaccaauuugcucuugggcagggaaccacacugaauaacgugcauucuaaugauaccguucacgaccggacgccguaucgcacacuccugaugaacgaacugggcgugcccuuccaucucgggaccaagcaggucugcauugccuggagcuccagcucuugucacgauggaaaagccuggcugcaugugugcguuacaggcgacgauaagaaugcuaccgccuccuuuaucuacaacggcagacuuguggacagcauugucucuugguccaaaaagauccugcggacccaggagagcgaaugugugugcauuaaugggacauguacgguggucaugaccgauggaucugcuuccggcaaagccgacacaaagauccucuucaucgaggaggggaagauuguucacaccagcacacuguccggaucugcgcaacacguggaagagugcagcugcuauccucgcuaccccggcgugagaugugucugccgggauaacuggaaaggguccaaccgcccuaucguggacauuaauaucaaggacuacagcauuguuucuuccuauguguguagcggacuugucggcgauacccccagaaagaacgacucuagcuccucuagccauugccuggauccgaauaacgaagagggcgggcacggagugaagggcugggccuuugacgaugggaaugacguuuggaugggacggacgaucuccgaaaaacuccgcagcggcuacgagacauucaaggugaucgagggguggucuaacccuaauuccaaacugcagauuaacagacaggucaucguggaucggggaaaucgcagcggcuauucuggcaucuuuuccgucgaagggaaaagcuguauuaacagacgguucuacguggagcugauuagaggacgcaaggaagagaccgaaguucucuggaccuccaauucuaucguggucuucugcggcacaagcgggaccuauggaacaggcuccuggcccgacggggcugauauuaaccugaugccuaucuga

SEQ ID NO: 209123 - RNA, 1410 nt, Artificial Sequence
  derived and/or modified sequence opt5 from neuraminidase__InfluenzaA__BAF47987
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacucgcugaguaccggaauuggagcaagccccagugugacauuaccggguuugccccuuucuccaaagauaacucuauccgccugagcgcgggaggcgacaucugggugacaagagagcccuaugucuccugcgauccugacaaguguuaccaauuugcucuugggcagggaaccacacugaauaacgugcauucuaaugauaagguucacgaccggaccccguaucgcacgcuccugaugaacgaacugggcgugcccuuccaucucgggacaaaacaggucugcauugccuggagcuccagcucuugucacgauggaaaggccuggcugcaugugugcguuaccggcgacgauaaaaaugcuacagccuccuuuaucuacaacggcagacuuguggacagcauugucucuugguccaagaaaauccugcggacccaggagagcgaaugugugugcauuaaugggaccuguacaguggucaugacggauggaucugcuuccggcaaggccgacaccaagauccucuucaucgaggaggggaaaauuguucacacaagcacccuguccggaucugcgcaacacguggaagagugcagcugcuauccucgcuaccccggcgugagaugugucugccgggauaacuggaagggguccaaccgcccuaucguggacauuaauaucaaagacuacagcauuguuucuuccuauguguguagcggacuugucggcgauacacccagaaagaacgacucuagcuccucuagccauugccuggauccgaauaacgaagagggcgggcacggagugaaaggcugggccuuugacgaugggaaugacguuuggaugggacggaccaucuccgaaaagcuccgcagcggcuacgagacguucaaagugaucgagggguggucuaacccuaauuccaagcugcagauuaacagacaggucaucguggaucggggaaaucgcagcggcuauucuggcauuuuuagcgucgaagggaaguccuguaucaacagaugcuucuacguggagcugauucggggaagaaaagaagagacagaaguucucuggaccuccaauucuaucguggucuucuguggcaccagcgggacauauggaaccggcuccuggcccgacggggcugauauuaaccugaugccuaucuga

SEQ ID NO: 209124 - RNA, 1410 nt, Artificial Sequence; identical to SEQ ID NO: 197738
  derived and/or modified sequence opt5 from neuraminidase__InfluenzaA__BAF47988

SEQ ID NO: 209125 - RNA, 1410 nt, Artificial Sequence; identical to SEQ ID NO: 197738
  derived and/or modified sequence opt5 from neuraminidase__InfluenzaA__BAF47989

SEQ ID NO: 209126 - RNA, 1410 nt, Artificial Sequence
  derived and/or modified sequence opt5 from neuraminidase__InfluenzaA__BAF47990
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacggugaucaugaccgacggauccgcuagcggcaaggccgauacaaaaauccucuuuauugaggaagggaagaucguccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgguuagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucucuggaccucuaacagcaucguggucuucuguggcacauccgggaccuauggaacaggcucuuggcccgauggggcugacauuaaucugaugccuaucuga

SEQ ID NO: 209127 - RNA, 1410 nt, Artificial Sequence
  derived and/or modified sequence opt5 from neuraminidase__InfluenzaA__BAF47991
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauauuguucacgaccggaccccguaucgcacgcuccugaugaacgaacugggcgugcccuuucaucucgggacaaagcaggucugcaucgccugguccucuagcuccugucacgauggaaaagccuggcugcaugugugcguuaccggcgacgauaagaaugcuacagccagcuucauuuacaacggcagacuuguggacucuaucgucuccuggagcaaaaagauucugcggacccaggagucugaaugugugugcaucaaugggaccuguacaguggucaugacggauggauccgcuagcggcaaagccgacaccaagauccucuuuauugaggaggggaagaucguucacacauccacccugucuggaagcgcgcaacacguggaagagugcuccugcuauccucgcuaccccggcauuagaugugugugccgggauaacuggaaagggagcaaccgcccuaucgucgacauuaauaucaaggacuacucuaucguguccagcuauguuuguucuggacuugugggcgauacaccccggaaaaacgacagcuccucuagcucccauugccuggauccgaauaacgaagagggcgggcacggagucaagggcugggccuucgacgaugggaaugacguguggaugggaagaaccauuagcgaaaaacuccgcucuggcuacgagacguuuaagguuaucgaggggugguccaacccuaauagcaaacugcagauuaacagacaggugaucgucgaucggggaaaucgcucuggcuauuccggcauuuucagcguggaagggaaguccuguaucaacagaugcuuuuacgucgagcugauucggggaagaaaggaagagacagaagugcucuggaccucuaauagcaucguuguguucuguggcaccuccgggacauauggaaccggcucuuggcccgacggggcugauaucaaccugaugccuauuuga

SEQ ID NO: 209128 - RNA, 1410 nt, Artificial Sequence
  derived and/or modified sequence opt5 from neuraminidase__InfluenzaA__BAF47992
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgaaccugacaaguguuacccguucgcucuugugcaagggaccacacugaacaauguucauagcaacgauaccgugcacgaccggacgcccuaucgcacacuccugaugaaugagcugggagucccuuuucaucucggcaccaaacaggugugcauugccugguccucuagcuccugucacgaugggaaggccuggcugcauguuugcgugacaggagacgauaagaacgcuaccgccagcuucaucuacaauggcagacuugucgacucuauuguguccuggagcaaagaaauccugcggacccaggagucugagugugugugcauuaacggcacauguacggucguuaugaccgauggguccgcuagcggaaaggccgacacaaaaauccucuuuaucgaagagggcaagauugugcacaccuccacacugucugggagcgcgcagcacguggaagagugcuccugcuauccccgcuacccuggagucagaugugugugccgggauaacuggaagggcagcaaucgccccaucguugacauuaacaucaaagauuacucuauuguguccagcuaugucuguucugggcuugugggagacaccccgagaaagaaugacagcuccucuagcggccauugccuggauccuaacaaugaagagggcgggcacggaguuaaaggcugggccuucgacgaugggaacgacguguggaugggacggacgaucuccgagaagcuccgcagcggcuacgaaacauuuaaagucaucgagggguggucuaaucccaacuccaagcugcaaauuaauagacaggugaucgucgaucggggaaaccgcagcggcuauucuggcauuuucuccguggaagggaaaagcuguaucaauagaugcuuuuacguugagcugauucggggaagaaaggaagagaccgaggugcucuggaccuccaacucuuucgucguguucuguggcacaagcgggaccuauggaacaggcuccuggccugacggggcugauaucaaucugaugcccauuuga

SEQ ID NO: 209129 - RNA, 1410 nt, Artificial Sequence; identical to SEQ ID NO: 209085
  derived and/or modified sequence opt5 from neuraminidase__InfluenzaA__BAF47993

SEQ ID NO: 209130 - RNA, 1410 nt, Artificial Sequence; identical to SEQ ID NO: 197736
  derived and/or modified sequence opt5 from neuraminidase__InfluenzaA__BAF47994

SEQ ID NO: 209131 - RNA, 1410 nt, Artificial Sequence
  derived and/or modified sequence opt5 from neuraminidase__InfluenzaA__BAF47995
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacggccggacgccguaucgcacacuccugaugaaugaacugggggugcccuuucaucucggaaccaagcaggucugcauugccugguccucuagcuccugucacgauggcaaagccuggcugcaugugugcguuacaggcgacgauaagaacgcuaccgccagcuucaucuacaaugggagacuuguggacucuauugucuccuggagcaaagagauccugcggacccaggaaucugagugugugugcauuaacggaacauguacgguggucaugaccgauggcuccgcuagcgggaaggccgacacaaaaauccucuuuaucgaggaaggaaagauuguucacaccuccacacugucuggcagcgcgcaacacguggaggaaugcuccugcuauccucgcuaccccggggugagaugugucugccgggauaacuggaagggaagcaaucgcccuaucguggacauuaacaucaaagauuacucuauuguuuccagcuauguguguucuggccuugucggcgacacccccagaaagaaugacagcuccucuagcucccauugccuggauccgaacaaugaggaagggggacacggcgugaaagggugggccuucgacgauggaaacgacguuuggaugggccggacgaucagcgagaagcuccgcucuggguacgagacauuuaaagugaucgaaggaugguccaauccuaacagcaagcugcagauuaauagacaggucaucguggaucggggcaaccgcucuggcuauuccgggauuuucagcgucgagggaaaauccuguaucaauagaugcuuuuacguggaacugauucggggcagaaaggaggaaaccgagguucucuggaccucuaacagcaucguggucuucugugggacauccggaaccuauggcacagggucuuggcccgacggcgcugauauuaaucugaugccuaucuga

SEQ ID NO: 209132 - RNA, 1410 nt, Artificial Sequence; identical to SEQ ID NO: 209131
  derived and/or modified sequence opt5 from neuraminidase__InfluenzaA__BAF47996

SEQ ID NO: 209133 - RNA, 1410 nt, Artificial Sequence; identical to SEQ ID NO: 197738
  derived and/or modified sequence opt5 from neuraminidase__InfluenzaA__BAF47997

SEQ ID NO: 209134 - RNA, 1410 nt, Artificial Sequence
  derived and/or modified sequence opt5 from neuraminidase__InfluenzaA__BAF57504
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucaguguaacauuaccggguucgcccccuuuuccaaagacaauucuauccgccugagcgcgggaggcgauaucugggugacaagagagccuuaugucuccucugacccggauaagugcuaccaauucgcucuugggcagggaaccacacugaacaaugugcauagcaacgacaccguucacgaucggacgcccuaucgcacacuccugaugaaggaacugggcgugccuuuucaucucgggaccaaacaggucuguauugccugguccucuagcuccugccacgacggaaaggccuggcugcauguguguguuacaggcgaugacgagaaugcuaccgccagcuucaucuacaacggcagacuuguggauucugucguguccuggagcaaaaagauucugcggacccaggaaucugagugcguguguaucaaugggacaugcacggucguuaugaccgacggauccgcuagcggcaaagccgauacaaagauucucuuuaucgaggaagggaagaucgugcacaccuccucucugagcggauccgcgcaacacguggaggaauguagcugcuauccccgcuacccuggcgucagaugcgugugucgggacaacuggaaagggucuaaccgccccauuguugauaucaauauuaaggacuacuccaucgugagcucuuaugucugcagcggacuugugggcgacacaccgcggaaaaacgauuccucuagcuccagccauugucuggacccuaauaacgaggaaggcgggcacggaguuaagggcugggccuucgaugacgggaaugauguguggaugggaagaaccauuucugagaaacuccgcuccggcuacgagacguuuaaggucaucgaaggguggagcaaccccaauucuaaacugcagaucaacagacaggugauugucgaccggggaaaucgcuccggcuauagcggcaucuucuccguggaggggaagucuugcauuaacagauguuuuuacguugaacugauccggggaagaaagcaggagacagaagugcucuggaccagcaauuccauugucguguucugcggcaccucugggacauauggaaccggcagcuggccugauggggcugacaucaaccugaugcccauuuga

SEQ ID NO: 209135 - RNA, 1410 nt, Artificial Sequence
  derived and/or modified sequence opt5 from neuraminidase__InfluenzaA__BAF57508
augaaccccaaucagaagaucauuaccaucggcagcgugucccugacaauuucuacgaucugcuucuuuaugcaaauugccauccucaucaccacacugacccuucacuucaaacaguacgaguuuaacagcccuccgaauaaccaggucaugcugugugaacccacaauuaucgagagaaauauuaccgaaaucguuuaucucacaaacaccacgauugagaaggaaaucugcccuaaacuggcugaguaccggaauugguccaagccccaguguaacauuaccggguucgccccuuuuucuaaagacaauagcauccgccuuuccgcgggaggcgauaucugggugacaagagagcccuaugugucuugcgacccugauaaguguuaccaauucgcucuggggcagggaaccacacucaacaauguccauagcaacgacaccgugcacgaucggacgccguaucgcacacugcugaugaaugaacucggcguucccuuucaucuggggaccaaacaggugugcauugccugguccucuagcuccugucacgacggaaaggccuggcuucaugucugcgugacaggcgaugacgagaacgcuaccgccagcuucaucuacaauggcagacugguugauucuauuguguccuggagcaagaaaauccuccggacccaggaaucugagugugucugcauuaacgggacauguacgguggugaugaccgacggauccgcuagcggcaaggccgauacaaaaauccuguuuaucgaggaagggaagauuguccacaccuccacacuuucuggaagcgcgcaacacguugaggaaugcuccugcuauccucgcuaccccggcgugagaugugugugccgggacaacuggaaggggagcaaucgcccuaucgucgauauuaacaucaaagacuacucuauuguguccagcuauguuuguucuggacuggugggcgacacccccagaaagaaugauagcuccucuagcucccauugccucgacccgaacaaugaggaaggcgggcacggagucaaaggcugggccuucgaugacgggaacgauguguggaugggacggacgaucagcgagaagcugcgcucuggcuacgagacauuuaaaguuaucgaagggugguccaauccuaacagcaagcugcagauuaauagacaggugaucgucgaccggggaaaccgcucuggcuauuccggcauuuucagcguggaggggaaauccuguaucaauagaugcuuuuacgucgaacucauucggggaagaaagcaggagaccgaagugcuguggaccucuaacagcaucguuguguucuguggcacauccgggaccuauggaacaggcucuuggcccgauggggcugacauuaaucuuaugccuaucuga

SEQ ID NO: 209136 - RNA, 1410 nt, Artificial Sequence; identical to SEQ ID NO: 198953
  derived and/or modified sequence opt5 from neuraminidase__InfluenzaA__BAF57511

SEQ ID NO: 209137 - RNA, 1410 nt, Artificial Sequence
  derived and/or modified sequence opt5 from neuraminidase__InfluenzaA__BAF57515
augaaccccaaucagagaaucauuaccaucggcagcgugucccugacaauuucuacgaucugcuucuuuaugcaaauugccauccucaucaccacagucacccugcacuucaagcaguacgaguuuaacagcccuccgaauaaccagguuaugcuuugugaacccacaauuaucgagcggaauauuaccgaaaucguguaucugacaaacaccacgauugagaaagaaaucugcccuaagcucgcugaguaccgcaauugguccaaaccccaguguaacauuaccggguucgccccuuuuucuaaggacaauagcaucagacuguccgcgggaggcgauaucugggugacacgggagcccuaugucucuugcgacccugauaaauguuaccaauucgcucuugggcagggaaccacacugaacaaugugcauagcaacgacaagguucacgaucgcaccccguauagaacgcuccugaugaaugaacugggcgugcccuuucaucucgggacaaagcaggucugcauugccugguccucuagcuccugucacgacggaaaagccuggcugcaugugugcguuaccggcgaugacgagaacgcuacagccagcuucaucuacaauggccggcuuguggauucuauugucuccuggagcaagaaaauccugcgcacccaggaaucugagugugugugcauuaacgggaccuguacaguggucaugacggacggauccgcuagcggcaaggccgauaccaaaauccucuuuaucgaggaagggaagauuguucacacauccacccugucuggaagcgcgcaacacguggaggaaugcuccugcuauccuagauaccccggcgugcggugugucugccgcgacaacuggaaggggagcaauagaccuaucguggauauuaacaucaaagacuacucuauuguuuccagcuaucuuuguucuggacuggugggcgacacaccccggaagaaugauagcuccucuagcucccauugccucgacccgaacaaugaggaaggcgggcacggagucaaaggcugggccuucgaugacgggaacgauguguggaugggacgcaccaucagcgagaagcugagaucuggcuacgagacguuuaaaguuaucgaaggguggucccauccuaauagccagcugcagauuaaccgccaggugaucgucgaccggggaaauagaucuggcuauuccggcauuuucagcguggaggggaaguccuguaucaaccggugcuuuuacgucgaacucauuagaggacgcaaacaagagacagaagugcuguggaccucuaauagcaucguuguguucuguggcaccuccgggacauauggaaccggcucuuggcccgauggggcugacauuaaccuuaugccuaucuga

SEQ ID NO: 209138 - RNA, 1410 nt, Artificial Sequence
  derived and/or modified sequence opt5 from neuraminidase__InfluenzaA__BAF57522
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccauuaucgagaaggaaauuugcccuaaacucgcugaguaccggaauugguccaagccccaguguaacaucacgggguucgccccuuuuucuaaagacaauagcauccgccuguccgcgggaggcgauauuugggugaccagagagcccuaugucucuugcgacccugauaaguguuaccaauucgcucuugggcagggaacaacccugaacaaugugcauagcaacgacacaguucacgaucggaccccguaucgcacgcuccugaugaaugaacugggcgugcccuuucaucucgggacaaagcaggucugcaucgccugguccucuagcuccugucacgacggaaaagccuggcugcaugugugcguuaccggcgaugacgagaacgcuacagccagcuucauuuacaauggcagacuuguggauucuaucgucuccuggagcaagaaaauucugcggacccaggaaucugagugugugugcaucaacgggaccuguacaguggucaugacggacggauccgcuagcggcaaggccgauaccaaaauccucuuuauugaggaagggaagaucguucacacauccacccugucuggaagcgcgcaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacacccagaaagaaugaucggagccgcuccucucauugccuggacccgaacaaugaggaaggcgggcacggagugaaaggcugggccuucgaugacgggaacgauguuuggaugggaagaaccaucagcgagaagcuccgguccggcuacgagacguuuaaagugauugaaggguggagcaagccuaauucuaaacugcagaucaaccgccaggucauuguggacagaggaaaucggacaggcuauuccggcaucuucagcgucgaggggaagucuuguauuaacagaugcuuuuacguggaacugauccgcggacggaagcaggagaccgaaguucucuggaccuccaauagcauuguggucuucuguggcacauccgggaccuauggaacaggcucuuggcccgauggggcugacaucaaccugaugccuaucuga

SEQ ID NO: 209139 - RNA, 1410 nt, Artificial Sequence
  derived and/or modified sequence opt5 from neuraminidase__InfluenzaA__BAF57529
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaagguucacgaacggaccccguaucgcacgcuccugaugaacgagcugggcgugcccuuucaucucgggacaaaacaggucugcauugccugguccucuagcuccugucacgacggaaaggccuggcugcaugugugcguuaccggcgaugacaaaaaugcuacagccagcuucaucuacaacggcagacuuguggauucuauugucuccuggagcaagaaaauccugcggacccaggaaucugagugugugugcauuaaugggaccuguacaguggucaugacggacggauccgcuagcggcaaggccgauaccaagauccucuuuaucgaggaagggaaaauuguucacacauccacccugucuggaagcgcgcaacacguggaggaaugcuccugcuauccucgcuaccccggcgugagaugugucugccgggacaacuggaaggggagcaaccgcccuaucguggauauuaauaucaaagacuacucuauuguuuccagcuauguguguucuggacuugucggcgacacacccagaaagaacgauagcuccucuagcucccauugccuggacccgaauaacgaggaaggcgggcacggagugaaaggcugggccuucgaugacgggaaugauguuuggaugggacggaccaucagcgagaagcuccgcucuggcuacgagacguuuaaagugaucgaagggugguccaacccuaauagcaagcugcagauuaacagacaggucaucguggaccggggaaaucgcucuggcuauuccggcauuuucagcgucgaggggaaguccuguaucaacagaugcuuuuacguggaacugauucggggaagaaaagaggaaacagagguucucuggaccucuaauagcaucguggucuucuguggcaccuccgggacauauggaaccggcucuuggcccgauggggcugacauuaaccugaugccuaucuga

SEQ ID NO: 209140 - RNA, 1410 nt, Artificial Sequence; identical to SEQ ID NO: 204575
  derived and/or modified sequence opt5 from neuraminidase__InfluenzaA__BAF57532

SEQ ID NO: 209141 - RNA, 1410 nt, Artificial Sequence; identical to SEQ ID NO: 204575
  derived and/or modified sequence opt5 from neuraminidase__InfluenzaA__BAF57536

SEQ ID NO: 209142 - RNA, 1410 nt, Artificial Sequence
  derived and/or modified sequence opt5 from neuraminidase__InfluenzaA__BAF57539
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuauugacucuaucguguccuggagcaaaaagauucugcggacccaggagucugaaugugucugcaucaaugggacauguacgguggugaugaccgauggauccgcuagcggcaaagccgacacaaagauccucuuuauugaggaggggaagaucguccacaccuccacacugucuggaagcgcgcaacacguugaagagugcuccugcuauccucgcuaccccggcgugagaugugugugccgggauaacuggaaagggagcaaccgcccuauugucgacaucaauauuaaggacuacucuaucguguccagcuauguuuguucuggacuugugggcgauacccccagaaagaacgacagcuccucuagcucccauugccuggauccgaauaacgaagagggcgggcacggagucaaaggcugggccuucgacgaugggaaugacguguggaugggacggacgaucagcgaaaaacuccgcucuggcuacgagacauuuaagguuauugaggggugguccaacccuaauagcaaacugcagaucaacagacaggugauugucgaucggggaaaucgcucuggcuauuccggcaucuucagcguggaagggaaguccuguauuaacagaugcuuuuacgucgagcugauccggggaagaaaggagaaaaccgaagugcucuggaccucuaauagcauuguuguguucuguggcacauccgggaccuauggaacaggcucuuggcccgacggggcugauaucaaccugaugccuaucuga

SEQ ID NO: 209143 - RNA, 1410 nt, Artificial Sequence
  derived and/or modified sequence opt5 from neuraminidase__InfluenzaA__BAF57543
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccgcuauuuucagcgucgaaggcaaguccuguaucaacagaugcuuuuacguggagcugauucgggggagaaaggaagagaccgaaguucucuggaccucuaauagcaucguggucuucuguggaacauccggcaccuaugggacaggaucuuggcccgacggcgccgauauuaaccugaugccuaucuga

SEQ ID NO: 209144 - RNA, 1410 nt, Artificial Sequence
  derived and/or modified sequence opt5 from neuraminidase__InfluenzaA__BAF57547
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccgaagcucucuggaccucuaauagcaucguuguguucuguggcacauccgggaccuauggaacaggcucuuggcccgacggggccgauauuaaccugaugccuaucuga

SEQ ID NO: 209145 - RNA, 1410 nt, Artificial Sequence; identical to SEQ ID NO: 197738
  derived and/or modified sequence opt5 from neuraminidase__InfluenzaA__BAF57551

SEQ ID NO: 209146 - RNA, 1410 nt, Artificial Sequence; identical to SEQ ID NO: 197738
  derived and/or modified sequence opt5 from neuraminidase__InfluenzaA__BAF57555

SEQ ID NO: 209147 - RNA, 1410 nt, Artificial Sequence; identical to SEQ ID NO: 197736
  derived and/or modified sequence opt5 from neuraminidase__InfluenzaA__BAF57559

SEQ ID NO: 209148 - RNA, 1410 nt, Artificial Sequence
  derived and/or modified sequence opt5 from neuraminidase__InfluenzaA__BAF57563
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauauuguucacgaccggaccccguaucgcacgcuccugaugaacgaacugggcgugcccuuucaucucgggacaaagcaggucugcaucgccugguccucuagcuccugucacgauggaaaagccuggcugcaugugugcguuaccggcgacgauaagaaugcuacagccagcuucauuuacaacggcagacuuguggacucuaucgucuccuggagcaaagagauucugcggacccaggaaucugagugugugugcaucaaugggaccuguacaguggucaugacggauggauccgcuagcggcaaggccgacaccaaaauccucuuuauugaggaagggaagaucguucacacauccacccugucuggaagcgcgcaacacguggaggaaugcuccugcuauccucgcuaccccggcgugagaugugucugccgggauaacuggaaggggagcaaccgcccuauuguggacaucaauauuaaagacuacucuaucguuuccagcuauguguguucuggacuugucggcgauacacccagaaagaacgacagcuccucuagcucccauugccuggauccgaauaacgaggaaggcgggcacggagugaaaggcugggccuucgacgaugggaaugacguuuggaugggacggaccaucagcgagaagcuccgcucuggcuacgagacguuuaaagugauugaagggugguccaacccuaauagcaagcugcagaucaacagacaggucauuguggaucggggaaaucgcucuggcuauuccggcaucuucagcgucgaggggaaauccuguauuaacagaugcuuuuacguggaacugauccggggaagaaaggaggaaacagagguucucuggaccucuaauagcauuguggucuucuguggcaccuccgggacauauggaaccggcucuuggcccgacggggcugauaucaaccugaugccuaucuga

SEQ ID NO: 209149 - RNA, 1410 nt, Artificial Sequence; identical to SEQ ID NO: 197736
  derived and/or modified sequence opt5 from neuraminidase__InfluenzaA__BAF57571

SEQ ID NO: 209150 - RNA, 1410 nt, Artificial Sequence; identical to SEQ ID NO: 204480
  derived and/or modified sequence opt5 from neuraminidase__InfluenzaA__BAF57575

SEQ ID NO: 209151 - RNA, 1410 nt, Artificial Sequence; identical to SEQ ID NO: 197351
  derived and/or modified sequence opt5 from neuraminidase__InfluenzaA__BAF57579

SEQ ID NO: 209152 - RNA, 1410 nt, Artificial Sequence
  derived and/or modified sequence opt5 from neuraminidase__InfluenzaA__BAF57583
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucagagugacacgggagcccuaugucucuugcgacccugauaaguguuaccaauucgcucuugggcagggaaccacacugaacaaugugcauagcaacgacaccguucacgaucgcacgccguauagaacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggccggcuuguggauucuauugucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccuagauaccccggcgugcggugugucugccgcgacaacuggaaggggagcaauagaccuaucguggauauuaacaucaaagacuacucuauuguuuccagcuauguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagcucagaucuggcuacgagacauuuaaagugaucgaagggugguccaauccuaacagcaagcugcagauuaaucggcaggucaucguggaccgcggaaacagaucuggcuauuccggcauuuucagcgucgaggggaaauccuguaucaaucggugcuuuuacguggaacugauuagaggacgcaaggaggaaaccgagguucucuggaccucuaacagcaucguggucuucuguggcacauccgggaccuauggaacaggcucuuggcccgauggggcugacauuaaucugaugccuaucuga

SEQ ID NO: 209153 - RNA, 1410 nt, Artificial Sequence
  derived and/or modified sequence opt5 from neuraminidase__InfluenzaA__BAF57587
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcaacauuaccggguucgccccuuuuucuaaagacaauagcauccgccuguccgcgggaggcgauaucugggugacaagagagcccuacgucucuugugacccugauaagugcuaucaauucgcucuugggcagggaaccacacugaacaaugugcauagcaacgacaccguucacgaucggacgccguaccgcacacuccugaugaaugaacugggcgugcccuuucaucucgggaccaagcaggucuguauugccugguccucuagcuccugccacgacggaaaagccuggcugcauguguguguuacaggcgaugacaagaacgcuaccgccagcuucaucuauaauggcagacuuguggauucuauugucuccuggagcaaagagauccugcggacccaggaaucugagugcguguguauuaacgggacaugcacgguggucaugaccgacggauccgcuagcggcaaggccgauacaaaaauccucuuuaucgaggaagggaagauuguucacaccuccacacugucuggaagcgcgcaacacguggaggaaugcuccuguuacccucgcuaucccggcgugagaugcgucugucgggacaacuggaaggggagcaaucgcccuaucguggauauuaacaucaaagacuacucuauuguuuccagcuacgugugcucuggacuugucggcgacacccccagaaagaaugauagcuccucuagcucccauugucuggacccgaacaaugaggaaggcgggcacggagugaaaggcugggccuucgaugacgggaacgauguuuggaugggacggacgaucagcgagaagcuccgcucuggcuaugagacauuuaaagugaucgaagggugguccaauccuaacagcaagcugcagauuaauagacaggucaucguggaccggggaaaccgcucuggcuacuccggcauuuucagcgucgaggggaaauccugcaucaauagauguuuuuauguggaacugauucggggaagaaaggaggaaaccgagguucucuggaccucuaacagcaucguggucuucugcggcacauccgggaccuacggaacaggcucuuggcccgauggggcugacauuaaucugaugccuaucuga

SEQ ID NO: 209154 - RNA, 1410 nt, Artificial Sequence
  derived and/or modified sequence opt5 from neuraminidase__InfluenzaA__BAF57591
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucgugcauauuaauaucaaagacuacucuauuguuuccagcuauguguguucuggacuugucggcgacacccccagaaagaacgauagcuccucuagcucccacugccugaauccgaacaaugaggaaggcgggcauggagugaaaggcugggccuucgacgaugggaacgacguuuggaugggacggacgaucagcgagaagcuccgccugggcuacgagacauuuaaagugaucgaaggguggucuaauccuaacuccaagcugcagauuaauagacaggucaucguggaucggggaaaccgcagcggcuauucuggcauuuucuccgucgaggggaaaagcuguaucaauagaugcuuuuacguggaacucauucggggaagaaaggaggaaaccgagguucuguggaccuccaacucuaucguggucuucuguggcacaagcgggaccuauggaacaggcuccuggcccgacggggcugauauuaaucuuaugccuaucuga

SEQ ID NO: 209155 - RNA, 1410 nt, Artificial Sequence
  derived and/or modified sequence opt5 from neuraminidase__InfluenzaA__BAF57595
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaaauugcugaguaccggaauugguccaagccccaguguaacaucaccggguucgccccuuuuucuaaagacaauagcauccgccucuccgcgggaggcgauauuugggugacaagagagcccuaugucucuugcgacccugauaaguguuaccaauucgcucuggggcagggaaccacacuuaacaaugugcauagcaacgacaccguucacgaucggacgccguaucgcacacugcucaugaaugaacugggcgugcccuuucaucuggggaccaagcaggucugcaucgccugguccucuagcuccugucacgacggaaaagccuggcuccaugugugcguuacaggcgaugacaagaacgcuaccgccagcuucauuuacaauggcagacugguggauucuaucgucuccuggagcaaagagauucuucggacccaggaaucugagugugugugcgugaacgggacauguacggucguuaugaccgacggauccgcuagcggcaaggccgauacaaaaauccuguuuaucgaggaagggaagauugugcacaccuccacacucucuggaagcgcgcaacacguggaggaaugcuccugcuauccucgcuaccccggcgucagaugugugugccgggacaacuggaaggggagcaaucgcccuaucguugauauuaacaucaaagacuacucuauuguguccagcuaugucuguucuggacuggugggcgacacccccagaaagaaugauagcuccucuagcucccauugccuugacccgaacaaugaggaaggcgggcacggaguuaaaggcugggccuucgaugacgggaacgauguguggaugggacggacgaucagcgagaagcugcgcucuggcuacgagacauuuaaagucaucgaagggugguccaauccuaacagcaagcuccagauuaauagacaggugaucgucgaccggggaaaccgcucuggcuauuccggcauuuucagcguggaggggaaauccuguaucaauagaugcuuuuacguugaacugauucggggaagaaaggaggaaaccgaggugcuguggaccucuaacagcaucgucguguucuguggcacauccgggaccuauggaacaggcucuuggcccgauggggcugacauuaaucucaugccuaucuga

SEQ ID NO: 209156 - RNA, 1410 nt, Artificial Sequence; identical to SEQ ID NO: 204480
  derived and/or modified sequence opt5 from neuraminidase__InfluenzaA__BAF57599

SEQ ID NO: 209157 - RNA, 1410 nt, Artificial Sequence
  derived and/or modified sequence opt5 from neuraminidase__InfluenzaA__BAF57603
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccugacagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucggcaccucuaauagcaucguggucuucugugggacauccggaaccuauggcacagggucuuggcccgacggcgcugauauuaaccugaugccuaucuga

SEQ ID NO: 209158 - RNA, 1410 nt, Artificial Sequence; identical to SEQ ID NO: 204575
  derived and/or modified sequence opt5 from Neuraminidase__InfluenzaA__BAF62620

SEQ ID NO: 209159 - RNA, 1413 nt, Artificial Sequence
  derived and/or modified sequence opt5 from neuraminidase__InfluenzaA__BAF63036
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucacaaucaauaacaccaauguuguggccggaaaagacaagacaucugugacccuggcgggcaacagcucccuuuguagcauuucugggugggcuaucuacacgaaagauaauuccauucggaucggaagcaagggcgacgucuucgugauucgcgagccuuuuaucucuugcucccaucuggaguguagaaccuucuuucucacacaaggcgcccugcuuaacgauaaacacagcaaugggaccguuaaggaccggucuccguaucgcgcccugauguccugcccccucggagaagcuccuagccccuacaacuccaaguucgagucuguggccuggagcgcuuccgccugucaugauggcaugggguggcugacaaucggaauuagcggcccugacaauggggcggucgccgugcugaaauauaacggaaucauuaccgaaacgaucaagucuuggaaaaagcggauucucagaacacaggaguccgagugcguuugugugaacggcagcugcuuuaccaucaugacagauggccccucuaauggggcugccagcuacaaaaucuucaagauugaaaagggaaaagucaccaaguccaucgagcugaacgcuccuaauuuucacuaugaagaguguucuugcuacccggacaccggcacagugaugugugugugccgcgauaacuggcacgggagcaauagacccugggucuccuucaaccagaaucuugacuaccagauuggauauaucugcagcggcguuuuuggggauaacccucggcccaaagacggaaagggcucuuguaauccugugacgguggauggcgccgacggggucaaaggauucuccuacaaguauggcaacgggguguggauuggacgcaccaaaagcaauagacugcggaagggcuuugagaugaucugggaccccaacggguggacagauaccgacucugauuucuccguuaagcaagacguggucgcgauuacagauuggagcggcuacuccggaucuuuugugcagcauccggaacucaccggccuggacugcauccgcccuuguuucuggguugagcuugugagagggcugccccgggaaaauacgacaaucuggaccagcggauccucuauuagcuucugcggcgucaacuccgauaccgccaauuggagcuggccugacggggcugagcuccccuuuacaaucgauaaauga

SEQ ID NO: 209160 - RNA, 1413 nt, Artificial Sequence; identical to SEQ ID NO: 204465
  derived and/or modified sequence opt5 from neuraminidase__InfluenzaA__BAF63040

SEQ ID NO: 209161 - RNA, 1413 nt, Artificial Sequence
  derived and/or modified sequence opt5 from neuraminidase__InfluenzaA__BAF63047
augaaccccaaucagaagaucauuaccaucggcagcauuuccaucgccauugggaucaucucucuggugcuccaaauuggaaacaucauuagcaucugggcuucccacucuauucagacaggcagccagaaucauacggggaucugcaaccagagaauuaucaccuacgagaauagcacaugggugaaccacaccuauguuaauaucaacaauacaaacgugguggccggaaaagacaagaccucugucacacuggcgggcaauagcucccuuuguagcauuucugggugggcuaucuacaccaaagauaacuccauucggaucggaagcaagggcgacguguucguuauucgcgaaccuuuuaucucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaauuagcggcccugacaacggggcgguggccguucugaaauauaacggaaucauuacagaaaccaucaagucuuggaaaaagcggauucucagaacgcaggaguccgagugcgugugugucaauggcagcugcuuuacaaucaugaccgauggccccucuaacggggcugccagcuacaaaaucuucaagauugaaaagggaaaagugacaaaguccaucgagcugaaugcuccuaacuuucacuaugaagaguguucuugcuacccggacaccggcaccgugaugugugucugccgcgauaauuggcacgggagcaacagacccuggguuuccuucaaucagaaccuugacuaccagauuggauauaucugcagcggcguguuuggggauaauccucggcccaaagacggagagggcucuuguaacccugugacagucgauggcgccgacggggugaagggauucuccuacaaauauggcaaugggguuuggauuggacgcacgaaguccaacagacugcggaaaggcuuugaaaugaucugggaccccaauggguggaccgauacagacucugauuucuccgugaagcaagacgucguggcgauuaccgauuggagcggcuacuccggaucuuuuguucagcauccggagcucacaggccuggacugcauccgcccuuguuucuggguggaacuugucagagggcugccccgggagaacaccacgaucuggacaagcggauccucuauuagcuucugcggcgucaauuccgauaccgccgacuggagcuggccugauggggcugaacuccccuuuaccaucgacaaguga

SEQ ID NO: 209162 - RNA, 1413 nt, Artificial Sequence
  derived and/or modified sequence opt5 from neuraminidase__InfluenzaA__BAF63058
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuugugcuauuagcgggugggccaucuacaccaaagauaacucuauucggaucggauccaagggcgacgucuucgugauucgcgagccuuuuaucagcugcucucaucuggaguguagaacguucuuucucacccaaggcgcccugcuuaaugauaaacacuccaacgggacaguuaaggaccggagcccguaucgcgcucugaugucuugcccccucggagaagccccuucccccuacaauagcaaguucgaguccguggcuuggucugccagcgcgugucaugauggcaugggguggcugaccaucggaauuuccggcccugacaacggggccgucgcugugcugaaauauaacggaaucauuacagaaaccaucaagagcuggaaaaagcggauucucagaacgcaggagucugagugcguuugugugaauggcuccugcuuuacaaucaugaccgauggccccagcaacgaagccgcuucuuacaaaaucuucaagauugagaaggggaaagucacaaagagcaucgaacugaaugccccuaacuuucacuaugaggaguguuccugcuacccggacaccggaaccgugaugugugugugccgcgauaauuggcacggcucuaacagacccugggucagcuucaauccuaaccuugacuaccagauuggguauaucugcuccggaguuuuuggcgauaauccccggccuaaagacggggaaggaagcuguaaccccgugacaguggauggcgcggacggcgucaagggguucucuuacaaauauggaaauggcguguggauugggcgcacgaaguccaacagacugcggaaaggauuugagaugguuugggacccgaauggcuggaccgauacagacagcgauuucucugugaagcaggacgucguggccaucaccgauugguccggguacagcggcuccuuuguucaacauccugaacucacaggacuggacugcauucgccccuguuucuggguggagcuugucagaggccugccuaaggaaaacaccacgaucuggacaucugggagcuccaucucuuucugcggagugaauagcgauaccgcuaacugguccuggcccgacggcgccgagcuccccuuuaccauugauaaauga

SEQ ID NO: 209163 - RNA, 1413 nt, Artificial Sequence; identical to SEQ ID NO: 204465
  derived and/or modified sequence opt5 from neuraminidase__InfluenzaA__BAF63065

SEQ ID NO: 209164 - RNA, 1413 nt, Artificial Sequence; identical to SEQ ID NO: 204465
  derived and/or modified sequence opt5 from neuraminidase__InfluenzaA__BAF63069

SEQ ID NO: 209165 - RNA, 1413 nt, Artificial Sequence; identical to SEQ ID NO: 204465
  derived and/or modified sequence opt5 from neuraminidase__InfluenzaA__BAF63079

SEQ ID NO: 209166 - RNA, 1413 nt, Artificial Sequence; identical to SEQ ID NO: 204465
  derived and/or modified sequence opt5 from neuraminidase__InfluenzaA__BAF63092

SEQ ID NO: 209167 - RNA, 1413 nt, Artificial Sequence; identical to SEQ ID NO: 204465
  derived and/or modified sequence opt5 from neuraminidase__InfluenzaA__BAF63098

SEQ ID NO: 209168 - RNA, 1413 nt, Artificial Sequence
  derived and/or modified sequence opt5 from neuraminidase__InfluenzaA__BAF63104
augaaccccaaucagaagaucauuaccaucggcagcauuuccaucgccauugggaucaucucucugaugcuccaagugggaauugucguuagcaucugggcuucccacucuauucagacaggcagccagaaccauacggggaucugcaaucagagaauuaucaccuacgagaacuccacaugggugaaucacaccuaugugaacauuaauaacacaaaugucguggccggaaaagacaagaccucuguugcgcuggcuggcaacagcucccuuuguagcaucucugggugggccaucuacacaaaagauaauuccauucggaucggaagcaagggcgacguguucgucauucgcgaaccuuuuaucucuugcucccaucuggaguguagaaccuucuuucucacgcaaggcgcccugcuuaacgauaaacacagcaaugggaccgugaaggaccggucuccguaucgcgcucugauguccugcccccucggagaagccccuagccccuacaacuccaaguucgagucuguugcuuggagcgccuccgcgugucaugauggcaugggguggcugacaauuggaaucagcggcccugacaauggggccguggcuguccugaaauauaacggaaucauuaccgaaacaaucaagucuuggaaaaagcggauucucagaacccaggaguccgagugcgugugugugaacggcagcugcuuuacgaucaugacagauggccccucuaauggggccgcuagcuacaaaauuuucaagaucgaaaagggacaggucaccaaauccguugagcugaacgccccuaauuuucacuaugaagaguguucuugcuacccggacacaggcaccgugaugugugugugccgcgauaacuggcacgggagcaauagacccugggucuccuucaaccagaaucuugacuaccaaaucggauauauuugcagcggcguguuuggggauaacccucggcccaaggacggaaaaggcucuuguaauccuguuaccguggauggcgcggacggggucaagggauucuccuacaaauauggcaacgggguguggaucggacgcacaaagagcaauagacugcggaaaggcuuugagaugauuugggaccccaacggguggacggauaccgacucugauuucuccguuaagcaggacguggucgccaucacagauuggagcggcuacuccggaucuuuugugcagcauccggaacucaccggccuggacugcauucgcccuuguuucugggucgagcuugugagagggcugccccgggaaaauacaaccaucuggacgagcggauccucuauuagcuucugcggcguugauuccgacacagcuaacuggagcuggccugauggggccgagcuccccuuuaccaucgacaaguga

SEQ ID NO: 209169 - RNA, 1413 nt, Artificial Sequence
  derived and/or modified sequence opt5 from neuraminidase__InfluenzaA__BAF63112
augaaccccaaucagaagaucauuaccaucggcagcauuuccaucgccauugggaucaucucucugaugcuccaagugggaaacauuaucagcauuugggcuucccacucuauccagacaggcagccagaaucauacggggauuugcaaccagagaaucauuaccuacgaaaauuccacaugggucaaccacaccuauguuaauaucaacaauacaaacgugguggccggaaaagacaagaccucugucgcgcuggcuggcaauagcucccuuuguagcaucucugggugggccauuuacacaaaagauaacuccauccggauuggaagcaagggcgacguguucguuauccgcgagccuuuuauuucuugcucccaucuggaguguagaaccuucuuucucacgcaaggcgcccugcuuaaugauaaacacagcaacgggaccgugaaggaccggucuccguaucgcgcucugauguccugcccccucggagaagccccuagccccuacaauuccaaguucgagucugucgcuuggagcgccuccgcgugucaugauggcaugggguggcugacaaucggaaucagcggcccugacaacggggccguggcuguucugaaauauaacggaauuaucaccgaaacaauuaagucuuggaaaaagagaauccuccggacccaggaguccgagugcgugugugucaauggcagcugcuuuacgauuaugacagauggccccucuaacggggccgcuagcuacaaaaucuucaagaucgaaaagggacaggugaccaaauccguggagcugaaugccccuaacuuucacuaugaagaguguucuugcuacccggacacaggcaccgucauguguguuugccgcgauaauuggcacgggagcaacagacccuggguguccuucaaucagaaccuugacuaccaaauuggauauaucugcagcggcguguuuggggauaauccucggcccaaggacggaaaaggcucuuguaacccugucaccguggauggcgcggacgggguuaagggauucuccuacaaauauggcaaugggguguggauuggacgcacaaagagcaacagacugcggaaaggcuuugagaugaucugggaccccaauggguggacggauaccgacucugauuucuccgucaagcaggacgugguugccauuacagauuggagcggcuacuccggaucuuuugugcagcauccggaacucaccggccuggacugcauccgcccuuguuucugggucgagcuugugagagggcugccccgggaaaacacaaccauuuggacgagcggauccucuaucagcuucugcggcgucgauuccgacacagcuaauuggagcuggccugauggggccgagcuccccuuuaccaucgacaaguga

SEQ ID NO: 209170 - RNA, 1413 nt, Artificial Sequence
  derived and/or modified sequence opt5 from neuraminidase__InfluenzaA__BAF63116
augaaccccaaucagaagaucauuaccaucggcagcauuuccaucgccauugggaucaucucucugaugcuccaagugggaaacauuaucagcauuugggcuucccacucuauccagacaggcagccagaaucauacggggauuugcaaccagagaaucauuaccuacgaaaauuccacaugggucaaccacaccuauguuaauaucaacaauacaaacgugguggccggaaaagacaagaccucugucgcgcuggcuggcaauagcucccuuuguagcaucucugggugggccauuuacacaaaagauaacuccauccggauuggaagcaagggcgacguguucguuauccgcgagccuuuuauuucuugcucccaucuggaguguagaaccuucuuucucacgcaaggcgcccugcuuaaugauaaacacagcaacgggaccgugaaggaccggucuccguaucgcgcucugauguccugcccccucggagaagccccuagccccuacaauuccaaguucgagucugucgcuuggagcgccuccgcgugucaugauggccugggguggcugacaaucggaaucagcggcccugacaacggggccguggcuguucucaaauauaacggaauuaucaccgaaacaauuaagucuuggaaaaagagaauccugcggacccaggaguccgagugcgugugugucaauggcagcugcuuuacgauuaugacagauggccccucuaacggggccgcuagcuacaaaaucuucaagaucgaaaagggacaggugaccaaauccguggagcuuaaugccccuaacuuucacuaugaagaguguucuugcuacccggacacaggcaccgucauguguguuugccgcgauaauuggcacgggagcaacagacccuggguguccuucaauccugaccuggauuaccagauuggauauaucugcagcggcguguuuggggacaacccccggccuaaggauggaaaaggcucuuguaaucccgucaccguggacggcgcggacgggguuaagggauucuccuacaaauauggcaacgggguguggauuggacgcacaaagagcaauagacuccggaaaggcuuugagaugaucugggauccgaacggguggacggacaccgauucugacuucuccgucaagcaagaugugguugccauuacagacuggagcggcuacuccggaucuuuugugcagcauccugaacugaccggccuugauugcauccgccccuguuucugggucgagcuggugagagggcucccucgggaaaauacaaccauuuggacgagcggauccucuaucagcuucugcggcgucgacuccgauacagcuaacuggagcuggcccgacggggccgagcugcccuuuaccaucgauaaguga

SEQ ID NO: 209171 - RNA, 1413 nt, Artificial Sequence
  derived and/or modified sequence opt5 from neuraminidase__InfluenzaA__BAF63124
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaagucccgcgagcugaaugcuccuaacuuucacuaugaagaguguucuugcuacccggacaccggcaccgugaugugugugugcagagauaauuggcacgggagcaaccggcccugggucuccuucaauccuaaccuugacuaccagaucggauauauuugcagcggcguugugggggauaauccccgcccuaaagacggaaagggcucuuguaaccccgugacagccgauggcgcggacggggucaaaggauuuuccuacaaguauggcaaugggguguggaucggaagaacgaaaagcaaccggcugcgcaagggcuucgagaugauuugggacccgaauggguggaccgauacagacucugauuuuuccguuaagcaggacguggucgccaucaccgauuggagcggcuacuccggaucuuucgugcaacauccugaacucacaggccuggacugcauuagacccuguuuuuggguugagcuugugcgggggcugccucgcgaaaacaccacgaucuggacaagcggauccucuaucagcuucugcggcgucgauuccgacaccgcuaauuggagcuggcccgauggggccgagcuccccuucaccauugacaaauga

SEQ ID NO: 209172 - RNA, 1413 nt, Artificial Sequence; identical to SEQ ID NO: 204527
  derived and/or modified sequence opt5 from neuraminidase__InfluenzaA__BAF63132

SEQ ID NO: 209173 - RNA, 1413 nt, Artificial Sequence
  derived and/or modified sequence opt5 from neuraminidase__InfluenzaA__BAF63136
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguaaaacguucuuucucacccaaggcgcccugcuuaaugauaagcacagcaacgggacaguuaaggacagaucuccguaucgggcccugauguccugcccccucggagaagcuccuagccccuacaauuccaaauucgagucuguggccuggagcgcuuccgccugucaugauggcaugggguggcugaccaucggaauuagcggcccugacaacggggcggucgccgugcugaaguauaacggaaucauuacaggcaccaucaaaucuuggaagaaacagauucuccgcacgcaggaauccgagugcguuuguaugaauggcagcugcuuuacaaucaugaccgaugggcccucuaacggagcugccagcuacaagaucuucaagauugagaaaggcaaggugacaaaauccaucgaacugaaugcuccuaacuuucacuaugaggaauguucuugcuacccggacaccgggaccgucaugugugugugcagagauaauuggcacggaagcaaccggcccuggguguccuucaaucagaaccuugacuaccaaauuggcuauaucugcagcggggucuuuggagauaauccucgccccaaggacggcgagggcucuuguaacccuguuacaguggauggggccaauggagugaaaggcuucuccuacaaguaugggaacggagucuggauuggcagaacgaaaagcaaucggcugcgcaagggguuugagaugaucugggaccccaacggcuggaccaauacagacucugauuucuccgugaagcaggacguuguggcgauuaccgauuggagcggauacuccggcucuuuuguccagcauccggaacucacagggcuggacugcaucagaccuuguuucuggguggagcuuguucggggacugccccgcgaaaacaccacgaucuggacaagcggcuccucuauuagcuucugcggggugaacuccgauaccgccaauuggagcuggccugacggagcugagcuccccuuuaccaucgauaaauga

SEQ ID NO: 209174 - RNA, 1350 nt, Artificial Sequence
  derived and/or modified sequence opt5 from neuraminidase__InfluenzaA__BAH24021
augaaccccaaucagaagaucauuaccaucggcagcauuugcauggugaucgggauugucucccugaugcuccaaaucggaaacaugguuucucugugggugagccacuccauccagacaggcaaucagcaucagguggagccuauuucuaacacgaauuuccuuaccgaaaaagccgucgcuagcgugacacuggccgggaacuccucucucuguccgaucagaggaugggcgguucacagcaaggacaauuccauucggaucggcagcaaaggggauguguuugucauucgcgagcccuucaucucuugcucccaucuggaauguagaaccuuuuuccuuacacaaggagcucugcucaacgacaagcacagcaauggcaccgugaaagaucggucuccucaucgcacacugauguccugccccguuggcgaggccccuagccccuacaacucuagauuugaauccguggccuggagcgcuuccgccugucacgacgggaccucuuggcugacgauuggaaucagcggcccugauaauggggcugucgccgugcucaaguauaacggaaugaucaccgacacaauuaaguccuggcggaauaacauccugcgcacccaggagagcgagugcgcgugugugaauggcucuugcuucacagucaugaccgaugggccguccaacggacaggccagcuacaaaauuuuuaagauggaaaaaggcaagguugugaaaucuguggagcuugacgcucccaacuaucacuacgaagaguguagcugcuauccugaugccggcgagaucacgugugucugcagagacaauuggcauggguccaaccggcccugggugucuuucaaucagaaccuggaauaccaaauuggauauaucugcagcggcguuuuuggggauaauccucgccccaacggaggcacaggguccuguggaccggugagcccuaauggcgcuuacggcgucaagggguucucuuuuaaguacggaaacggcguguggaucgggagaaccaaaucccccagcucucgguccggauucgagaugauuugggacccuaauggcuggacagaaaccgauagcuccuuuucuguuaagcaggacaucguggccauuaccgacuggagcggguauuccggcucuuucguccagcaccccgagcucacaggacuggauugcauccgccccuguuucuggguggaacuuauuagaggccggccuaaagagagcacgaucuggaccuccgggagcucuaucuccuuuugcggagucaacagcgacacagugucuugguccuggccggauggcgcggagcugcccuucaccauugacaaguga

SEQ ID NO: 209175 - RNA, 1410 nt, Artificial Sequence; identical to SEQ ID NO: 199917
  derived and/or modified sequence opt5 from neuraminidase__InfluenzaA__BAH95825

SEQ ID NO: 209176 - RNA, 1410 nt, Artificial Sequence; identical to SEQ ID NO: 199752
  derived and/or modified sequence opt5 from neuraminidase__InfluenzaA__BAH95826

SEQ ID NO: 209177 - RNA, 1410 nt, Artificial Sequence
  derived and/or modified sequence opt5 from neuraminidase__InfluenzaA__BAJ07994
augaaccccaaucagaagaucaccacaauuggcagcaucugcauggugauugggaucgucucccugaugcuccaaauuggaaacaucaucucuauuuggguuagccacuccauccagacgggcaaucagcaucaggccgagccuuguaaccaaucuauuaucaccuacgaaaauaacacaugggugaaucagaccuaugugaacauuagcaauacaaacuuccugaccgagaaagcugucgccuccgugacacuugcgggaaauucuagccugugcccgaucuccgggugggcuguuuacagcaaggacaacggcauuagaaucgggucuaaaggagauguguuugucauccgggaacccuucauuuccuguagccaccucgagugccgcaucuuuuuccugacccagggcgcccuucugaaugacaagcauucuaacggcacggugaaagauagauccccucaccggacccucaugagcugucccguuggggaagccccuucucccuauaauucccgcuuugagagcguggcuugguccgccucugcuugccaugacggaacaagcuggcugaccauuggcaucuccgggccugauaacggagccgucgcggugcugaaguacaacggcauuaucacagacaccaucaagagcuggagaaauaacauuaugcggacgcaggagucugaaugugccugcgugaauggguccuguuucacagucaugaccgauggaccgagcaacggccaagcuagcuauaaaaucuuucgcauugagaagggcaaaguugugaagucugccgaacucaaugcucccaacuaccacuaugaggagugcuccuguuacccugacgccggggaaaucacaugcgugugcagagauaauuggcacggaucuaaccggcccugggucagcuucaaucagaaccuggaguaccgcauuggcuauaucuguuccgggguguuuggagacaauccuagacccaacgauggcaccgggagcugcggaccgguuucuccuaaaggcgcguacggcaucaagggguucuccuuuaaguauggaaauggcguguggauugggcggaccaaaagcacaaacucucgcuccggauucgaaaugaucugggaccccaauggcuggacggggaccgauagcaacuuuuccgucaagcaggacauuguggccaucacagacuggucuggcuacagcggauccuucguucagcauccugagcuuaccggccuggauuguauuagacccugcuucuggguggaacucauccgggggcgccccaaagagucuacaauuuggaccagcggauccagcaucucuuuuuguggcgucaacuccgacacggugggguggagcuggccugauggagcugagcugccguucacaaucgacaaguga

SEQ ID NO: 209178 - RNA, 1350 nt, Artificial Sequence
  derived and/or modified sequence opt5 from neuraminidase__InfluenzaA__BAK23415
augaaccccaaucagaagaucauuaccaucggcagcgugugcaugauuaucgggauugucucccugaugcuccaaaucggaaacaugaucucuauuuggguuggccacagcauccagacagggaaucagugucaugccgagccuauuuccaacacgaaauucccgaccgaaaaggcugccgcgucugugacacuggcuggaaauagcucccuuugccccaucucuggcugggccguguacagcaaagacaacuccauuagaaucgggagccggggagaugucuuugugauucgcgagccuuucaucucuuguucccaccuggaaugcagaaccuuuuuccucacacagggcgcccugcuuaaugacaagcauagcaacggcaccguuaaagaucggucuccccaccgcacacugauguccuguccugugggggaggcucccagcccuuauaauucuagauuugaauccgucgccuggagcgcuuccgccugccaugacggaaccucuuggcucacgaucggcauuagcgggccggauaacggagcgguggccguucugaaguacaauggcaucauuaccgacacaaucaaguccuggcggaacaauauucugcgcacccaagagagcgagugugcuugcaucaacgggucuuguuucacagugaugaccgauggacccuccagcggccaggccucuuauaaaaucuuuaagauggaaaaaggcaaggucgugaaaagcguggagcucgacgcuccuaauuaccacuaugaagagugcuccuguuaccccgaugccggggagauuacgugcgucugcagagacaacuggcacggaucuaaccggccuuggguuagcuucaaucagaaccuggaauaucagaucggcuacauuuguuccgggguguuuggagauaauccccgcccgaacgacggcacagggagcugcggaccugugucucccaauggcgcguacggcgucaagggguucuccuuuaaguauggaaacggcguguggaucgggagaaccaaaagcacaaauucucgguccggauucgagaugauuugggauccuaacggcuggaccgggaccgacagcuccuuuucuguuaagcaagacaucguggccaucacagauuggagcggcuacuccggaucuuucguccagcaucccgaacuuacgggccuggacuguauucgccccugcuucuggguggagcucaucagagggcggccuaaagaaagcaccauuuggacauccggaagcucuaucuccuuuuguggcguuaauagcgauaccgugucuugguccuggccggacggggcugagcugcccuucacaauugauaaguga

SEQ ID NO: 209179 - RNA, 1350 nt, Artificial Sequence
  derived and/or modified sequence opt5 from neuraminidase__InfluenzaA__BAK23416
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaccagcuggcugacgaucggaauuuccggcccugauaacggggccguugcggugcugaaguacaauggaaucauuaccgacacaaucaagagcuggcggaacaauauucuccgcacccaggagucugagugugccugcgucaacggcuccuguuucacagugaugaccgaugggccgagcucuggacaggcuagcuauaaaaucuuuaagauggaaaaaggcaagguggucaaauccguugagcuggacgcccccaauuaccauuaugaagagugcucuuguuacccugaugcuggcgagaucacgugcgugugcagagacaacuggcacgggagcaaccggcccuggguguccuucaaucagaaccuugaauaucaaauuggauacaucuguagcggcgucuuuggggauaauccucgccccaacgacggaacaggcucuugcgggccggccuccccuaauggagcguacggcgugaagggcuucagcuuuaaguaugggaacggaguuuggauuggcagaaccaaaucuacaaauucccggagcggguucgagaugaucugggaucccaacggauggaccggcaccgacuccucuuuuagcgugaagcaggacauugucgccaucacagauugguccggguacucuggcagcuucgugcagcacccugaacugacgggacucgacuguauccgccccugcuucuggguugagcugauuagaggccggcccaaagaauccaccaucuggacaagcgggucuuccauuagcuuuuguggagucaauucugauaccguguccuggagcuggccugacggcgcugagcuuccguucacaaucgauaaguga

SEQ ID NO: 209180 - RNA, 1350 nt, Artificial Sequence
  derived and/or modified sequence opt5 from neuraminidase__InfluenzaA__BAK23417
augaaccccaaucagaagaucauuaccaucggcagcauuugcauggugaucgggauugucucccugaugcuccaaaucggaaacaugaucucuauuuggguuagccacuccauccagacaggcaaucagugucagucugagccuauuagcaacacgaaauuccugaccgaaaaggccguggcuuccgugacacuugccggaaauucuagccugugcccgaucuccgggugggcggucuacagcaaagacaacucuauuagaaucggcucccgcggggauguguuuguuauucgggagcccuucaucagcuguucucaucucgaaugcagaaccuuuuuccugacacaaggagcccuucugaaugacaagcacuccaacggcaccgugaaagaucggagcccucaucgcacacucaugucuugucccgucggcgaggcuccuucccccuauaauagcagauuugaauccguggccuggucugcuagcgccugccacgacgggaucuccuggcugaccauuggaaucagcggcccugauaacggggcuguugccgugcugaaguacaauggaauuaucacggacaccauuaagucuuggcggaacaauauccuccgcacacaggaguccgagugugcgugcgucaacggcagcuguuucaccgugaugacagaugggccgucuagcggacaggccuccuauaaaaucuuuaagauggaaaaaggcaagguggucaaaucuguugagcuggacgcucccaauuaccauuaugaagagugcagcuguuacccugaugccggcgagauuaccugcgugugcagagacaacuggcacggguccaaccggcccugggugagcuucaaucagaaccuugaauaucaaaucggauacauuuguucuggcgucuuuggggauaauccucgccccaacgacggaacgggcuccugcgggccggugagcccuaauggagcuuacggcguuaagggcuucucuuuuaaguaugggaacggaguguggaucggcagaacaaaauccaccaauagccgguccggguucgagaugauuugggaucccaacggauggacaggcaccgacucuagcuuuuccgucaagcaggacaucguggccaucaccgauuggucuggguacagcggcuccuucguucagcacccugaacugacaggacucgacuguauucgccccugcuucuggguggagcugaucagaggccggcccaaagaaagcacgauuuggaccucuggguccagcaucucuuuuuguggagucaauggcgauacaguguccuggagcuggccugacggggcggagcuuccguucaccauugauaaguga

SEQ ID NO: 209181 - RNA, 1350 nt, Artificial Sequence
  derived and/or modified sequence opt5 from neuraminidase__InfluenzaA__BAK23418
augaaccccaaucagaccaucauuacaaucggcagcauuugcauggugaucgggauugucucccugaugcuccaaaucggaaacaugaucucuauuuggguuagccacuccauccagacgggcaaucagugucaggccgagccuauuucuaacaccaaguuccugacagaaaaagcuguggccagcgugacccuugcgggaaauuccucucugugcccgaucagcgggugggcugucuacuccaaggacaacagcauuagaaucggcucucgcggggauguguuuguuauucgggagcccuucaucuccuguagccaucucgaaugcagaacauuuuuccugacccaaggagcccuucugaaugacaaacacucuaacggcacagugaaggaucgguccccucaucgcacccucaugagcugucccgucggcgaggccccuucucccuauaauuccagauuugaaagcguggcuugguccgccucugcuugccacgacgggacgagcuggcugaccaucggaauuuccggcccugauaacggggccguugcggugcugaaauacaauggaaucauuacagacaccaucaagagcuggcggaacaauauucuccgcacacaggagucugagugugccugcgucaacggcuccuguuucaccgugaugacggaugggccgagcucuggacaggcuagcuauaagaucuuuaaaauggaaaagggcaaaguggucaaguccguugagcuggacgcccccaauuaccauuaugaagagugcucuuguuacccugaugcuggcgagaucacaugcgugugcagagacaacuggcacgggagcaaccggcccuggguguccuucaaucagaaccuugaauaucaaauuggauacaucuguagcggcgucuuuggggauaauccucgccccaacgacggaaccggcucuugcgggccgguguccccuaauggagccuacggcguuaaaggcuucagcuuuaaguaugggaacggaguguggauuggcagaacaaagucuaccaauucccggagcggguucgagaugaucugggaucccaacggauggaccggcacagacuccucuuuuagcgucaaacaggacauuguggcgaucacggauugguccggguacucuggcagcuucguucagcacccugaacugaccggacucgacuguauccgccccugcuucuggguggagcugauuagaggccggcccaaggaauccacaaucuggaccagcgggucuuccauuagcuuuuguggagucaauucugauacaguguccuggagcuggccugacggcgccgagcuuccguucaccaucgauaaauga

SEQ ID NO: 209182 - RNA, 1350 nt, Artificial Sequence; identical to SEQ ID NO: 199601
  derived and/or modified sequence opt5 from neuraminidase__InfluenzaA__BAK23420

SEQ ID NO: 209183 - RNA, 1350 nt, Artificial Sequence; identical to SEQ ID NO: 199601
  derived and/or modified sequence opt5 from neuraminidase__InfluenzaA__BAK23421

SEQ ID NO: 209184 - RNA, 1350 nt, Artificial Sequence
  derived and/or modified sequence opt5 from neuraminidase__InfluenzaA__BAK23422
augaaccccaaucagaagaucauuaccaucggcagcgugugcauggucauugggaucguuucccugaugcuccaaauuggaaacaugaucucuaucugggugggccacagcauucagacagggaaucagugucaugccgagccuaucuccaacacgaaauucccgaccgaaaaggcugccgcgucugugacacuggcuggaaauagcucccuuugccccauuucuggcugggccgucuacagcaaagacaacuccaucagaauugggagccggggagauguguuuguuauccgcgagccuuucauuucuuguucccaccuggaaugcagaaccuuuuuccucacacagggcgcccugcuuaaugacaagcauagcaacggcaccgugaaagaucggucuccccaccgcacacugauguccuguccugucggggaggcucccagcccuuauaauucuagauuugaauccguggccuggagcgcuuccgccugccaugacggaaccucuuggcucacgaucggcaucagcgggccggauaacggagcgguugccgugcugaaguacaauggcauuaucaccgacacaauuaaguccuggcggaacaauauccugcgcacccaagagagcgagugugcuugcgucaacgggucuuguuucacagugaugaccgauggacccuccagcggccaggccucuuauaaaauuuuuaagauggaaaaaggcaagguggucaaaagcguugagcucgacgcuccuaauuaccacuaugaagagugcuccuguuaccccgaugccggggagaucacgugcgugugcagagacaacuggcacggaucuaaccggccuugggugagcuucaaucagaaccuggaauaucagaucggcuacauuuguuccggggucuuuggagauaauccccgcccgaacgacggcacagggagcugcggaccugugucucccaauggcgcguacggcguuaagggguucuccuuuaaguauggaaacggcguguggaucgggagaaccaaaagcacaaauucucgguccggauucgagaugauuugggauccuaacggcuggaccgggaccgacagcuccuuuucugucaagcaagacaucguggccauuacagauuggagcggcuacuccggaucuuucguucagcaucccgaacuuacgggccuggacuguauccgccccugcuucuggguggagcucaucagagggcggccuaaagaaagcaccauuuggacauccggaagcucuaucuccuuuuguggcgucaauagcgauaccgugucuugguccuggccggacggggcugagcugcccuucacaauugauaaguga

SEQ ID NO: 209185 - RNA, 1350 nt, Artificial Sequence
  derived and/or modified sequence opt5 from neuraminidase__InfluenzaA__BAK23423
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuacgaccaaauuccugacagaaaaggcuguggccagcgugacccuugcggggaacuccucucugugcccgaucagcggaugggcugucuacuccaaagacaauagcauuagaaucggcccccgcggggauguguuuguuauucgggagccuuucaucucuuguucccaucucgaaugcagaacauuuuuccugacccaaggagcccuucugaacgacaagcacagcaauggcacagugaaagaucggucuccccaucgcacccucauguccuguccugucggcgaggcccccagcccuuauaacucuagauuugaauccguggcuuggagcgccuccgcuugccacgacgggaucucuuggcugacgauuggaaucagcggcccggauaauggggccguugcggugcugaaguacaacggaauuaucaccgacacaauuaaguccuggcggaauaacauccuccgcacccaggagagcgagugugccugcgucaauggcucuuguuucacagugaugaccgaugggcccuccagcggacaggcuucuuauaaaaucuuuaagauggaaaaaggcaagguggucaaaagcguugagcuggacgccccuaacuaccauuaugaagagugcuccuguuaccccgaugcuggcgagauuacgugcgugugcagagacaauuggcacgggucuaaccggccuugggugagcuucaaccagaaucuugaauaucaaaucggauacauuuguuccggcgucuuuggggauaacccccgcccgaaugacggaacaggcagcugcgggccugugucucccaacggagccuacggcguuaagggcuucuccuuuaaguaugggaauggaguguggaucggcagaaccaaaagcacaaacucucgguccggguucgagaugauuugggauccuaauggauggaccggcaccgacagcuccuuuucugucaagcaggacaucguggcgaucacagauuggagcggguacuccggcucuuucguucagcaccccgaacugacgggacucgacuguauucgccccugcuucuggguggagcugaucagaggccggccuaaagaaagcaccauuuggacauccgggagcucuaucuccuuuuguggagucaacagcgauaccgugucuugguccuggccggacggcgccgagcuucccuucacaauugauaaguga

SEQ ID NO: 209186 - RNA, 1350 nt, Artificial Sequence
  derived and/or modified sequence opt5 from neuraminidase__InfluenzaA__BAK23424
augaaccccaaucagaagaucauuaccaucggcagcauuugcauggugaucgggauugucucccugaugcuccaaaucggaaacaugaucucuauuuggguuagccacuccauccagacaggcaaucagugucagggggagccuauuucuaacacgaaauuccugaccgaaaaggccguggcuagcgugacacuugccggaaauuccucucugugcccgaucagcggcugggcggucuacuccaaagacaacagcauuagaaucgggucucggggagauguguuuguuauucgcgagcccuucaucuccuguagccaucucgaaugcagaaccuuuuuccugacacaaggcgcccuucugaaugacaagcacucuaacggcaccgugaaagaucgguccccucaucgcacacucaugagcugucccgucggggaggcuccuucucccuauaauuccagauuugaaagcguggccugguccgcuucugccugccacgacggaaccagcuggcugacgaucggcauuuccgggccugauaacggagcuguugccgugcugaaguacaauggcaucauuaccgacacaaucaagagcuggcggaacaauauucuccgcacccaggagucugagugugcgugcgucaacggguccuguuucacagugaugaccgauggaccgagcucuggccaggccagcuauaaaaucuuuaagauggaaaaaggcaagguggucaaauccguugagcuggacgcucccaauuaccauuaugaagagugcucuuguuacccugaugccggggagaucacgugcgugugcagagacaacuggcacggaagcaaccggcccuggguguccuucaaucagaaccuugaauaucaaauuggcuacaucuguagcggggucuuuggagauaauccucgccccaacgacggcacagggucuugcggaccgguguucuccaauggcgcuuacggcguuaagggguuuagcuucaaguauggaaacggcguguggauugggagaaccaaaucuacaaauucccggagcggauuugagaugaucugggauccuaacggcuggaccgggaccgacuccucuuucagcggcaagcaggacauugucgccaucacagauugguccggauacucuggcagcuucgugcagcaccccgaacugacggggcucgacuguauccgcccuugcuuuuggguugagcugauuagaggacggcccaaagaauccaccaucuggacaagcgggucuuccauuagcuucuguggcgucaauucugauaccguguccuggagcuggcccgacggagcggagcuuccuuuuacaaucgauaaguga

SEQ ID NO: 209187 - RNA, 1350 nt, Artificial Sequence
  derived and/or modified sequence opt5 from neuraminidase__InfluenzaA__BAK23425
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaucagcuggcugaccauuggaaucuccggcccugauaacggggccguugcggugcugaaguacaauggaauuaucacggacaccauuaagagcuggcggaacaauauccuccgcacacaggagucugagugugccugcgucaacggcuccuguuucaccgugaugacagaugggccgagcucuggacaggcuagcuauaaaaucuuuaagauggaaaaaggcaagguggucaaauccguugagcuggacgcccccaauuaccauuaugaagagugcucuuguuacccugaugcuggcgagauuaccugcgugugcagagacaacuggcacgggagcaaccggcccuggguguccuucaaucagaaccuugaauaucaaaucggauacauuuguagcggcgucuuuggggauaauccucgccccaacgacggaacgggcucuugcgggccgguguccccuaauggagccuacggcguuaagggcuucagcuuuaaguaugggaacggaguguggaucggcagaacaaaaucuaccaauucccggagcggguucgagaugauuugggaucccaacggauggaucggcacagacuccucuuuuagcgucaagcaggacaucguggcgauuaccgauugguccggguacucuggcagcuucguucagcacccugaacugaccggacucgacuguauccgccccugcuucuggguggagcugauuagaggccggcccaaagaauccacaaucuggacgagcgggucuuccauuagcuuuuguggagucaauucugauaccguguccuggagcuggccugacggcgccgagcuuccguucacaaucgauaaguga

SEQ ID NO: 209188 - RNA, 1350 nt, Artificial Sequence
  derived and/or modified sequence opt5 from neuraminidase__InfluenzaA__BAK23426
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauucuuuaccgaaaaggcuguggccagcgugacacuggcgggaaauuccucucuuugcccgaucagcgggugggcugucuacuccaaagacaacagcauuagaaucggcucucgcggggauguguucauuauccgggagcccuuuaucuccuguagccaucuggaaugcagaaccuucuuucucacacaaggagcccugcuuaaugacaagcacucuaacggcaccguuaaagaucgguccccucaucgcacacugaugagcugucccgugggcgaggccccuucucccuauaauuccagauucgaaagcgucgcuugguccgccucugcuugccacgacgggaccagcuggcucacgauuggaaucuccggcccugauaacggggccguggcgguucugaaguacaauggaauuaucaccgacacaauuaagagcuggcggaacaauauccugcgcacccaggagucugagugugccugcgugaacggcuccuguuuuacagucaugaccgaugggccgagcucuggacaggcuagcuauaaaaucuucaagauggaaaaaggcaagguggugaaauccgucgagcucgacgcccccaauuaccauuaugaagagugcucuuguuacccugaugcuggcgagauuacgugcguuugcagagacaacuggcacgggagcaaccggcccuggguguccuuuaaucagaaccuggaauaucaaaucggauacauuuguagcggcguguucggggauaauccucgccccaacgacggaacaggcucuugcgggccggucuccccuaauggagccuacggcgugaagggcuuuagcuucaaguaugggaacggaguuuggaucggcagaaccaaaucuacaaauucccggagcggguuugagaugauuugggaucccaacggauggaccggcaccgacuccucuuucagcgugaagcaggacaucgucgcgaucacagauugguccggguacucuggcagcuucgugcagcacccugaacuuacgggacuggacuguauucgccccugcuuuuggguugagcucaucagaggccggcccaaagaauccaccauuuggacaagcgggucuuccaucagcuucuguggagucaauucugauaccguguccuggagcuggccugacggcgccgagcugccguuuacaauugauaaguga

SEQ ID NO: 209189 - RNA, 1350 nt, Artificial Sequence; identical to SEQ ID NO: 209187
  derived and/or modified sequence opt5 from neuraminidase__InfluenzaA__BAK23427

SEQ ID NO: 209190 - RNA, 1350 nt, Artificial Sequence
  derived and/or modified sequence opt5 from neuraminidase__InfluenzaA__BAK23428
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaccagcuggcugacgaucggaauuuccggcccugauaacggggccguugcggugcugaaguacaauggaaucauuaccgacacaaucaagagcuggcggaacaauauucuccgcacccaggagucugagugugccugcgucaacggcuccuguuucacagugaugaccgaugggccgagcucuggacaggcuagcuauaaaaucuuuaagauggaaaaaggcaagguggucaaauccguugagcuggacgcccccaauuaccauuaugaagagugcucuuguuacccugaugcuggcgagaucacgugcgugugcagagacaacuggcacgggagcaaccggcccuggguguccuucaaucagaaccuugaauaucaaauuggauacaucuguagcggcgucuuuggggauaauccucgccccaacgacggaacaggcucuugcgggccgguguccccuaauggagccuacggcguuaagggcuucagcuuuaaguaugggaacggaguguggauuggcagaaccaaaucuacaaauucccggagcggguucgagaugaucugggaucccaacggauggaccggcaccgacuccucugucagcgugaagcaggacauuguugcgaucacagauugguccggguacucuggcagcuuugugcagcacccugaacugacgggacucgacuguauccgccccugcuucagagucgagcugauucggggccgccccaaagaauccaccaucuggacaagcgggucuuccauuagcuucuguggagucaauucugauaccguguccuggagcuggccugacggcgccgagcuuccguuuacaaucgauaaguga

SEQ ID NO: 209191 - RNA, 1350 nt, Artificial Sequence; identical to SEQ ID NO: 209187
  derived and/or modified sequence opt5 from neuraminidase__InfluenzaA__BAK23429

SEQ ID NO: 209192 - RNA, 1350 nt, Artificial Sequence
  derived and/or modified sequence opt5 from neuraminidase__InfluenzaA__BAK23430
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaucagcuggcugaccauuggaaucuccggcccugauaacggggccguugcggugcugaaguacaauggaauuaucacggacaccauuaagagcuggcggaacaauauccuccgcacacaggagucugagugugccugcgucaacggcuccuguuucaccgugaugacagaugggccgagcucuggacaggcuagcuauaaaaucuuuaagauggaaaaaggcaagguggucaaauccguugagcuggacgcccccaauuaccauuaugaagagugcucuuguuacccugaugcuggcgagauuaccugcgugugcagagacaacuggcacgggagcaaccggcccuggguguccuucaaucagaaccuugaauaucaaaucggauacauuuguagcggcgucuuuggggauaauccucgccccaacgacggaacgggcucuugcgggccgguguccccuaauggagccuacggcguuaagggcuucagcuuuaaguaugggaacggaguguggaucggcagaacaaaaucuaccaauucccggagcggguucgagaugauuugggaucccaacggauggaucggcacagacuccucuuuuagcgucaagcaggacaucguggcgauuaccgauugguccggguacucuggcagcuucguucagcacccugaacugaccggacucgacuguaugcgccccugcuucuggguggagcugaucagaggccggcccaaagaauccacaauuuggacgagcgggucuuccaucagcuuuuguggagucaauucugauaccguguccuggagcuggccugacggcgccgagcuuccguucacaauugauaaguga

SEQ ID NO: 209193 - RNA, 1350 nt, Artificial Sequence
  derived and/or modified sequence opt5 from neuraminidase__InfluenzaA__BAK23431
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcggaugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaccagcuggcugacgaucggaauuuccggcccugauaacggggccguugcggugcugaaguacaauggaaucauuaccgacacaaucaagagcuggcggaacaauauucuccgcacccaggagucugagugugccugcgucaacggcuccuguuucacagugaugaccgaugggccgagcucuggacaggcuagcuauaaaaucuuuaagauggaaaaaggcaagguggucaaauccguugagcuggacgcccccaauuaccauuaugaagagugcucuuguuacccugaugcuggcgagaucacgugcgugugcagagacaacuggcacgggagcaaccggcccuggguguccuucaaucagaaccuugaauaucaaauuggauacaucuguagcggcgucuuuggggauaauccucgccccaacgacggaacaggcucuugcgggccgguguccccuaauggagccuacggcguuaagggcuucagcuuuaaguaugggaacggaguguggauuggcagaaccaaaucuacaaauucccggagcggguucgagaugaucuggggacccaacggcuggaccgggaccgauuccucuuuuagcgucaagcaggacauuguggcgaucacagacugguccggcuacucugggagcuucguucagcacccugaacugacgggccucgauuguauccgccccugcuucuggguggagcugauuagagggcggcccaaagaauccaccaucuggacaagcggaucuuccauuagcuuuuguggcgucaauucugacaccguguccuggagcuggccugauggggccgagcuuccguucacaaucgacaaguga

SEQ ID NO: 209194 - RNA, 1350 nt, Artificial Sequence; identical to SEQ ID NO: 209187
  derived and/or modified sequence opt5 from neuraminidase__InfluenzaA__BAK23432

SEQ ID NO: 209195 - RNA, 1350 nt, Artificial Sequence; identical to SEQ ID NO: 209187
  derived and/or modified sequence opt5 from neuraminidase__InfluenzaA__BAK23433

SEQ ID NO: 209196 - RNA, 1410 nt, Artificial Sequence
  derived and/or modified sequence opt5 from neuraminidase__InfluenzaA__BAM65748
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuuccaauuugcucuugggcagggaaccacacugaauaacgugcauagcaaugauaccguucacgaccggacgccguaccgcacacuccugaugaacgaacugggcgugcccuuccaucucgggaccaagcaggucugcauugccugguccuccucuuccugucacgauggaaaagccuggcugcaugugugcguuacaggcgacgauaagaaugcuaccgccagcuuuaucuauaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuucaucgaggaggggaagauuguucacaccuccacacugucuggaagcgcgcaacacguggaagagugcuccugcuacccucgcuaucccggcgugagaugugucugccgggauaacuggaaagggagcaaccgcccuaucguggacauuaauaucaaggacuacucuauuguuuccagcuacguguguucuggacuugucggcgauacccccagaaaaacggacagcuccucuagcucccauugccuggauccgaacaaugaagagggcgggcacggagugaagggcugggccuuugacgaugggaacgacguuuggaugggacggacaaucagcgaaaaaucucgccucggcuaugagaccuucaaggugaucgggggaugguccaauccuaacagcaaaucucagauuaauagacaggucaucguggauaugggcaaccgguccggcuacagcgggauuuuuagcgucgagggaaagucuuguaucaaucgcugcuucuauguggaacugauuagaggccggaaggacgagaccgaaguucuguggacaagcaacuccaucguggucuucugugggaccucuggaacauacggcacggggagcuggcccgauggcgcugacauuaaacucauguccaucuga

SEQ ID NO: 209197 - RNA, 1350 nt, Artificial Sequence
  derived and/or modified sequence opt5 from neuraminidase__InfluenzaA__BAM85817
augaaccccaaucagaagaucauuaccaucggcagcauuugcauggugacagggaucgucucccugaugcuccaaauuggaaacaugaucucuaucuggguuagccacuccauucauacgggcaaucagcaccagucugagccuaucagcaacaccaauuuccugacagaaaaagccguggcuuccgugaaacuugccgggaacucuagccuguguccgauuaauggaugggcggucuacuccaaggacaacagcaucagaauuggcucuaagggggauguguuuguuauccgggagcccuucauuuccugcagccaucucgaaugucgcaccuuuuuccugacacagggagcccuucugaaugacaaacacucuaacggcaccgugaaggauagauccccucaucggacacucaugagcugccccgucggcgaggcuccuucucccuauaauucccgcuuugaaagcguggccugguccgcuucugccugucacgacgggaccagcuggcugacgaucggaaucuccggcccugauaacggggcuguugccgugcugaaguacaauggaauuaucaccgacacaauuaaaagcuggagaaacaauauccuccggacccaagagucugagugcgcgugugucaacggcuccugcuucacagugaugaccgaugggccgagcaacggacaggccucucacaagauuuuuaaaauggaaaagggcaaaguggucaagagcguugagcuggacgcucccaauuaucauuacgaagaguguuccugcuauccuaacgccggcgagaucacgugugugugccgcgauaauuggcacgggucuaacagacccugggugagcuucaaucagaaccuugaauaccagaucggauauauuugcuccggcgucuuuggggacaauccucggcccaacgauggaacaggcagcugugggccggugucuuccaauggagcuuacggcguuaagggcuucagcuuuaaauacgggaacggaguguggaucggccgcaccaagucuacaaauuccagaagcggguucgagaugauuugggacccuaacggauggaccgaaaccgauuccucuuuuagcgucaaacaagacaucguggccauuacagacugguccggcuauucugggagcuucguucagcaucccgagcugacgggccucgauugcauccggccuuguuucuggguggaacugauccgcggaagacccaaggaguccaccauuuggacaagcgggucuuccaucagcuuuugcggcgucaauucugacaccgugggaugguccuggcccgauggcgcggagcuuccuuucacaauugacaaauga

SEQ ID NO: 209198 - RNA, 1350 nt, Artificial Sequence
  derived and/or modified sequence opt5 from neuraminidase__InfluenzaA__BAM85818
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgauccggggaugggcuguccacucuaaagacaacagcauucgcaucggcuccaagggggauguguuuguuauuagagagcccuucaucagcugcucucaucucgaaugucggaccuuuuuccugacacaaggagcccuucugaaugacaaacacuccaacggcaccgugaaggaucgcagcccucauagaacacucaugucuugccccgucggcgaggccccuucccccuacaauagccgguuugaaucuguggcuugguccgccagcgcuugucacgacgggaccuccuggcugacgaucggaauuucuggcccugauaacggggccguugcggugcugaaauauaauggaaucauuaccgacacaaucaagagcuggcgcaacaauauucucagaacccaggaguccgagugcgccugugucaacggcagcugcuucacagugaugaccgaugggccgucuaacggacaggcuuccuacaagaucuuuaaaauggaaaagggcaaaguggucaagagcguugagcugaaugcccccaacuaucacuacgaagaguguucuugcuauccugacgcuggcgagaucauuugugugugccgggauaauuggcaugggagcaaccgccccuggguguccuucaaucagaaccuugaauaccaaaucggauauauuugcucuggcgucuuuggggacaauccuagacccaacgauggaacgggcagcugugggccgguguccccuaauggagccuacggcaucaaaggcuucagcuuuaaguacgggaacggaguuuggauuggccggacaaagucuaccaauucccgcagcggguucgagaugaucugggaccccaacggauggacaggcaccgauucuaauuuuuccgugaaacaggacaucgucgcgauuaccgacuggagcggguauuccggcucuuucgugcagcacccugaacugacaggacucgauugcaucagacccuguuucuggguugagcugauucggggccgccccaaggaaagcacgaucuggaccuccgggucuagcauuuccuuuugcggagugaacagcgacacagucucuugguccuggccugauggcgccgagcuuccguucaccaucgacaaauga

SEQ ID NO: 209199 - RNA, 1350 nt, Artificial Sequence
  derived and/or modified sequence opt5 from neuraminidase__InfluenzaA__BAM85819
augaaccccaaucagaagaucauuaccaucggcagcauuugcauggugaucgggauugucucccugaugcuccaaaucggaaacaugaucucuauuuggguuagccacuccauccagacaggcaaucagaaccagguggagccuauuaucaauacgaacuuccugaccgaaaaagccguggcuucuauuacacuugccgggaauagcucccuguguccgaucagaggaugggcgauucauucuaaggacaacagcauccggaucggcuccaaaggggaugucuuugugauucgcgagcccuucaucagcugcucucaccucgaauguagaaccuuuuuccugacacaaggagcccuucugaaugacaagcauuccaacggcaccguuaaagaucggagcccucaccgcacacucaugucuugccccgugggcgaggcuccuucccccuacaauagcagauuugaaucugucgccugguccgcuagcgccugucaugacgggaccuccuggcugacgauuggaaucucuggcccugauaacggggcuguggccguucugaaguauaauggaauuaucaccgacacaaucaagagcuggcggaacaauauucuccgcacccaggaguccgagugcgcgugugugaacggcagcugcuucacagucaugaccgaugggccgucugacggacaggccuccuacaaaaucuuuaagauggaaaaaggcaaggugauuaaaagcguggagcuggaugcucccaacuaucacuacgaagaguguucuugcuauccugacgccggcgagaucacgugugucugcagagauaauuggcacgggagcaaccggcccuggguuuccuucaaucagaaccuugaauaccaaauuggauauaucugcucuggcguguuuggggacaauccucgccccaacgauggaacaggcagcugugggccggugucccauaauggagcuuacggcgucaagggcuucagcuuuaaguacgggaacggaguguggaucggcagaaccaaaucuccuaauucccggagcggguucgagaugauuugggaccccaacggauggucugaaacagacuccagcuuuuccguuaagcaggauaucguggccauuaccgacuggucuggcuauagcggguccuucguccagcacccugagcugaccggccucgauugcauccgccccuguuucuggguggaacugauuagaggacggcccaaagagucuacaguuuggacgagcggcuccagcaucucuuuuugcgggguguccagcgacaccgucucuugguccuggccugauggagcggagcuuccguucacaauugacaaguga

SEQ ID NO: 209200 - RNA, 1350 nt, Artificial Sequence
  derived and/or modified sequence opt5 from neuraminidase__InfluenzaA__BAM85820
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuucuaacacgaauuuccugaccgaaaaagcuguggccagcgugacacuugcggggaacuccucucuguguccgaucagaggaugggcuguccacagcaaggacaauuccauucggaucggcagcaaaggggauguguuuguuauucgcgagcccuucaucucuugcucccaucucgaauguagaaccuuuuuccugacacaaggagcccuucugaacgacaagcacagcaauggcaccgugaaagaucggucuccucaucgcacacucauguccugccccgucggcgaggccccuagccccuacaacucuagauuugaauccguggcuuggagcgccuccgcuugucacgacgggaccucuuggcugacgaucggaauuagcggcccugauaauggggccguugcggugcugaaguauaacggaaucauuaccgacacaaucaaguccuggcggaauaacauucuccgcacccaggagagcgagugcgccugugucaauggcucuugcuucacagugaugaccgaugggccguccaacggacaggcuagcuacaaaaucuuuaagauggaaaaaggcaagguggucaaaucuguugagcuggacgcccccaacuaucacuacgaagaguguagcugcuauccugaugcuggcgagaucacgugugugugcagagacaauuggcauggguccaaccggcccugggugucuuucaaucagaaccuugaauaccaaauuggauauaucugcagcggcgucuuuggggauaauccucgccccaacgacggaacaggcuccugugggccggugagcccuaauggagccuacggcguuaagggcuucucuuuuaaguacgggaacggaguguggauuggcagaaccaaauccacaaauagccggucuggguucgagaugaucugggaucccaacggauggaccggcaccgacuccagcuuuuccgucaagcaggacauuguggcgaucacagauuggucuggguauagcggcuccuucguucagcacccugaacugacgggacucgacugcauccgccccuguuucuggguggagcugauuagaggccggcccaaagaaucuaccaucuggacaagcggguccagcauuucuuuuugcggagucaauuccgauaccgugagcuggucuuggccugacggcgccgagcuuccguucacaaucgauaaguga

SEQ ID NO: 209201 - RNA, 1350 nt, Artificial Sequence; identical to SEQ ID NO: 198032
  derived and/or modified sequence opt5 from neuraminidase__InfluenzaA__BAM85821

SEQ ID NO: 209202 - RNA, 1350 nt, Artificial Sequence
  derived and/or modified sequence opt5 from neuraminidase__InfluenzaA__BAM85822
augaaccccaaucagaagaucauuaccaucggcagcauuugcauggugacagggaucgucucccugaugcuccaaauuggaaacaugaucucuaucuggguuagccacuccauucauacgggcaaucagcaccagucugagccuaucagcaacaccaauuuccugacagaaaaagccguggcuuccgugaaacuugccgggaacucuagccuguguccgauuaauggaugggcggucuacuccaaggacaacagcaucagaauuggcucuaagggggauguguuuguuauccgggagcccuucauuuccugcagccaucucgaaugucgcaccuuuuuccugacacagggagcccuucugaaugacaaacacucuaacggcaccgugaaggauagauccccucaucggacacucaugagcugccccgucggcgaggcuccuucucccuauaauucccgcuuugaaagcguggccugguccgcuucugccugucacgacgggaccagcuggcugacgaucggaaucuccggcccugauaacggggcuguugccguggucaaguacaauggaauuaucaccgacacaauuaaaagcuggagaaacaauauccugcggacccaagagucugagugcgcgugugugaacggcuccugcuucacagugaugaccgaugggccgagcaacucucaggccagccacaagauuuuuaaaauggaaaagggaaaagucguuaaguccguggagcucgacgcucccaauuaucauuacgaagaguguucuugcuauccugaugccggcgagaucacgugugugugccgcgacaacuggcacggcagcaauagacccugggucuccuucaaccagaaucuggaauaccagaucggguauauuugcagcggaguguuuggcgauaacccucggcccaaugacgggacaggaucuuguggcccgguuuccagcaacggggcuuacggagugaagggcuucucuuuuaaauacggcaauggggucuggaucggacgcaccaaguccacaaacagcagauccggcuucgagaugauuugggauccuaauggguggaccgaaaccgacucuagcuuuuccgugaaacaagacaucguugccauuacagauuggucuggauauagcggcuccuucgugcagcaucccgagcuuacggggcuggacugcauccggccuuguuucugggucgaacucauccgcggcagacccaaggagagcaccauuuggacaucuggauccagcaucucuuuuugcggcgugaacuccgauaccgucggguggagcuggcccgacggagcggagcugccuuucacaauugauaaauga

SEQ ID NO: 209203 - RNA, 1410 nt, Artificial Sequence
  derived and/or modified sequence opt5 from neuraminidase__InfluenzaA__BAM85823
augaaccccaaucagaagaucaccacaauuggcagcaucugcauggugauugggaucgucucccugaugcuccaaauuggaaacaucaucucuauuuggguuagccacuccauccagacgggcaaucagcaucaggccgggccuuguaaccaaucuauuaucaccuacgagaauaacacaugggugaaucagaccuaugugaacauuagcaauacaaacuuccugaccgagaaaacagucgcuuccgugacccuugccggaaauucuagccugugcccgaucuccggcugggcgguuuacagcaaggacaacgggauuagaaucggaucuaaaggcgauguguuugucauccgggaacccuucauuuccuguagccaccucgaaugccgcacguuuuuccugacccagggcgcccuucugaaugacaagcauucuaacgggacagugaaagauagauccccucaccggacccucaugagcugucccguuggagaggcuccuucucccuauaauucccgcuuugaaagcguggccugguccgcuucugccugccaugacggcaucaacuggcugacaauugggaucagcggaccugauaacggcgcugucgccgugcugaaguacaaugggauuaucaccgacacgaucaaguccuggagaaacaauauucuccggacacaggagagcgagugugcgugcgugaacggaucuuguuucaccaucaugacagauggcccguccaauggccaagccagcuauaaaauuuuucgcaucgaaaaggggaaagucguuaagucuguggagcugaacgcucccaauuaccacuaugaagagugcagcuguuacccugacgccggagagauuaccugcgugugcagagauaacuggcacggcuccaaucggcccugggucucuuucaaccagaaucuugaauaccagaucggguauaucuguagcggaauuuuuggcgacaacccucgccccaaugaugggaccggauccugcggcccggugagcccuaacggcgcuuacgggaucaaaggauucucuuuuaaguauggcaaugggguuuggauuggaagaacaaaguccacgaacagccggucuggcuucgagaugaucugggaccccaacggguggaccggcacagauuccaauuuuagcgugaaacaggacauugucgccaucaccgacugguccggauacucuggcagcuucgugcaacauccugaacugacagggcucgauuguauucgccccugcuucuggguugagcugaucagaggacggcccaaggaauccaccaucuggacgucuggcagcuccauuagcuuuuguggggugaacucugacacagucggaugguccuggccugauggcgcggagcuuccguucaccaucgacaaauga

SEQ ID NO: 209204 - RNA, 1350 nt, Artificial Sequence
  derived and/or modified sequence opt5 from neuraminidase__InfluenzaA__BAM85824
augaaccccaaucagaagaucauuaccaucggcagcauuugcauggugaucgggauugucucccugcuccugcaaaucggaaacaugaucucuauuuggaucagccacuccauucagacaggcaaucagcaucaggccgagucuaucagcaacacgaauccucuuaccgaaaaagcuguugccuccgugacacuggcggggaacucuagccucuguccgauuagaggaugggcugugcacuccaaggacaauagcauccggauuggcucuaaaggggaugucuucgugauccgcgagcccuuuaucuccugcagccaucuggaauguagaaccuucuuucuuacacaaggagcccugcucaacgacaagcacucuaauggcaccguuaaagaucgguccccucaucgcacacugaugagcugccccgugggcgaggccccuucucccuacaacuccagauucgaaagcgucgcuugguccgccucugcuugucacgacgggaccagcuggcugacgauuggaaucuccggcccugauaauggggccguggcgguucucaaguauaacggaauuaucaccgacacaauuaagagcuggcggaauaacauccugcgcacccaggagucugagugcgccugugugaauggcuccugcuuuacagucaugaccgaugggccgagcaacggacaggcuucuuacaaaaucuucaagauggaaaaaggcaagguggugaaaagcgucgagcuugacgcccccaacuaucacuacgaagaguguuccugcuauccugaugcuucugagauuacguguguuugcagagacaauuggcauggcagcaaccggcccuggguguccuuuaaucagaaccuggaauaccaaaucggguauauuugcagcggaguguucggcgauaauccucgccccaacgacgggacaggaucuuguggcccgauguuuccuaauggggccuacggaaucaagggcuucuccuuuaaguacggcaacggggucuggauuggaagaaccaaaagcacaaauucucgguccggcuucgagaugaucugggaucccaacggguggaccggaaccgacagcuccuuuucugugaagcaggacaucguugcgauuacagauuggagcggcuauuccgggucuuucgugcagcacccugaacucacgggccuggacugcauccgccccuguuucugggucgagcuuauuagaggacggcccaaagaaagcaccaucuggacauccggcagcucuauuuccuuuugcggggugaauagcgauaccguuucuugguccuggccugacggagccgagcugccguucacaaucgauaaguga

SEQ ID NO: 209205 - RNA, 1350 nt, Artificial Sequence
  derived and/or modified sequence opt5 from neuraminidase__InfluenzaA__BAM85825
augaaccccaaucagaagaucauuaccaucggcagcauuugcauggugaucgggauugucucccugaugcuccaaaucggaaacaugaucucuauuuggguuagccacuccauccagacaggcaaucagaaccagguggagccuauuaucaauacgaacuuccugaccgaaaaagccguggcuucuauuacacuugccgggaauagcucccuguguccgaucagaggaugggcgauucauucuaaggacaacagcauccggaucggcuccaaaggggaugucuuugugauucgcgagcccuucaucagcugcucucaccucgaauguagaaccuuuuuccugacacaaggagcccuucugaaugacaagcauuccaacggcaccguuaaagaucggagcccucaccgcacacucaugucuugccccgugggcgaggcuccuucccccuacaauagcagauuugaaucugucgccugguccgcuagcgccugucaugacgggaccuccuggcugacgauuggaaucucuggcccugauaacggggcuguggccguucugaaguauaauggaauuaucaccgacacaaucaagagcuggcggaacaauauucuccgcacccaggaguccgagugcgcgugugugaacggcagcugcuucacagucaugaccgaugggccgucuaacggacaggccuccuacaaaaucuuuaagauggaaaaaggcaaggugauuaaaagcguggagcuggacgcucccaauuaucacuacgaagaguguucuugcuauccugaugccggcgagaucacgugugucugcagagacaacuggcacgggagcaaucggcccuggguuuccuucaaccagaaucuugaauaccaaauuggauauaucugcucuggcguguuuggggauaacccucgccccaaugacggaacaggcagcugugggccggugucccauaacggagcuuacggcgucaagggcuucagcuuuaaguacgggaauggaguguggaucggcagaaccaaaucuccuaacucccggagcggguucgagaugauuugggaucccaauggauggucugaaacagacuccagcuuuuccguuaagcaggacaucguggccauuaccgauuggucuggcuauagcggguccuucguccagcacccugagcugaccggccucgacugcauccgccccuguuucuggguggaacugauuagaggacggcccaaagagucuacaguuuggacgagcggcuccagcaucucuuuuugcggggugaacuccgauaccgucagcuggucuuggccugacggagcggagcuuccguucacaauugauaaguga

SEQ ID NO: 209206 - RNA, 1350 nt, Artificial Sequence
  derived and/or modified sequence opt5 from neuraminidase__InfluenzaA__BAM85826
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccgugaaagaucgcuccccucauagaacacucaugagcugccccgucggcgaggccccuucucccuauaauucccgguuugaaagcguggcuugguccgccucugcuugucacgacgggaccagcuggcugacgaucggaauuuccggcccugauaacggggccguugcggugcugaaguacaauggaaucauuaccgacacaaucaagagcuggcgcaacaauauucucagaacccaggagucugagugcgccugugucaacggcuccugcuucacagugaugaccgaugggccgagcaauggacaggcuucuuauaaaaucuuuaagauggaaaaaggcaagguggucaaaagcguugagcuggacgcccccaacuaccauuaugaagaguguuccugcuacccugaugcuggcgagaucacgugugugugccgggacaacuggcacgggucuaaucgccccugggugagcuucaaccagaaucuugaauaucaaauuggauacaucugcuccggcgucuuuggggauaacccuagacccaaugacggaacaggcagcugugggccggugucucugaacggagccuacggcguuaagggcuucuccuuuaaguaugggaauggaguguggauuggccggaccaaaagcacaaacucucgcuccggguucgagaugaucugggauccuaauggauggaccggcaccgacagcuccuuuucugucaagcaggacauuguggcgaucacagauuggagcggguacuccggcucuuucguucagcaccccgaacucacgggacuggacugcaucagaccuuguuucuggguggagcuuauucggggccgccccaaagaaagcaccaucuggacauccgggagcucuauuuccuuuugcggagucaacagcgauaccgugucuugguccuggcccgacggcgccgagcugccuuucacaaucgauaaguga

SEQ ID NO: 209207 - RNA, 1350 nt, Artificial Sequence
  derived and/or modified sequence opt5 from neuraminidase__InfluenzaA__BAM85827
augaaccccaaucagaagaucauuaccaucggcagcauuugcauggugaucggggucguuucccugaugcuccaaacaggaaacauuaucucuaucugggugagccacuccauucagaaaggcaaucagcaucaggccgagucuaucagcaacacgaauccucugaccgaaaaggcuguggccuccgucacacuugcggggaacucuagccuguguccgauuagaggaugggcugugcacuccaaagacaauaacauccggauuggcagcaagggggauguuuucgugauccgcgagcccuuuauuucuugcucccaucucgaauguagaaccuucuuucugacacaaggagcccuucugaaugacaaacacagcaacggcaccgucaaggaucggucuccucaucgcacacucauguccugccccgugggcgaggccccuagccccuacaauucuagauucgaauccguugcuuggagcgccuccgcuugucacgacgggaccucuuggcugacgaucggaaucagcggcccugauaacgaggccguggcgguccugaaguauaaugggauuaucaccgacacaauuaaauccuggcggaacaauauccuccgcacccaggagagcgaaugcgccugugugaacggaucuugcuuuacagugaugaccgauggcccguccaacgggcaggcuagcuacaagauuuucaaaauggagaagggaaaagucguuaagucuguggaacuggacgcccccaauuaucacuacgaggaguguagcugcuauccugaugcuggcgaaaucacgugugugugcagagacaacuggcauggcuccaaucggcccugggucucuuuuaaccagaaucuugaguaccaaaucggguauauuugcagcggaguguucggcgauaacccucgccccaaugacgggacaggauccuguggcccgaugagcccuaacggggccuacggaguuaagggcuuuucuuucaaauacggcaaugggguguggaucggaagaaccaaguccacaaccagccggucuggcuuugaaaugauuugggaucccaacggguggaccggaacagacuccagcuucuccgucaaacaggacaucguggcgauuacggauuggucuggcuauagcggguccuuuguucagcacccugagcugaccggccucgacugcauccgccccuguuucuggguggaacugaucagaggacggcccaaggagucuacaauuuggaccagcggcuccagcaucucuuucugcggggucgauuccgacacagugagcuggucuuggccugauggagccgagcuuccguuuaccauugacaaauga

SEQ ID NO: 209208 - RNA, 1350 nt, Artificial Sequence
  derived and/or modified sequence opt5 from neuraminidase__InfluenzaA__BAM85828
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccgugaaagaucgcuccccucauagaacacucaugagcugccccgucggcgaggccccuucucccuauaauucccgguuugaaagcguggcuugguccgccucugcuugucacgacgggaccagcuggcugacgaucggaauuuccggcccugauaacggggccguugcggugcugaaguacaauggaaucauuaccgacacaaucaagagcuggcgcaacaauauucucagaacccaggagucugagugcgccugugucaacggcuccugcuucacagugaugaccgaugggccgagcaauggacaggcuucuuauaaaaucuuuaagauggaaaaaggcaagguggucaaaagcguugagcuggacgcccccaacuaccauuaugaagaguguuccugcuacccugaugcuggcgagaucacgugugugugccgggacaacuggcacgggucuaaucgccccugggugagcuucaaccagaaucuugaauaucaaauuggauacaucugcuccggcgucuuuggggauaacccuagacccaaugacggaacaggcagcugugggccggugucuccuaacggagccuacggcguuaagggcuucuccuuuaaguaugggaauggaguguggauuggccggaccaaaagcacaaacucucgcuccggguucgagaugaucugggaucccaauggauggaccggcaccgacagcuccuuuucugucaagcaggacauuguggcgaucacagauuggagcggguacuccggcucuuucguucagcacccugaacugacgggacucgacugcaucagacccuguuucuggguggagcugauucggggccgccccaaagaaagcaccaucuggacauccgggagcucuauuuccuuuugcggagucaacagcgauaccgugucuugguccuggccugacggcgccgagcuuccguucacaaucgauaaguga

SEQ ID NO: 209209 - RNA, 1350 nt, Artificial Sequence
  derived and/or modified sequence opt5 from neuraminidase__InfluenzaA__BAM85829
augaaccccaaucagaagaucauuaccaucggcagcauuugcaugaucauugggaucgugucccugaugcuccaaaucggaaacauuaucucuauuugggucagccacuccauccagacaggcaaucagcaucaggccgagccuauuucugacacgaacuuccugaccgaaaaagcuguugccagcgugauccuugcgggaaauuccucucugugucacauuagcgggugggcugugcauuccaaggauaacagcaucagaaucggcucuaaaggggacgucuuugugauucgggagccguucaucuccugcagccaccucgaaugucgcacauuuuuccugacccaaggagcccuucugaaugauaagcauucuaacggcacaguuaaagacagaagcccccaccggacccucauguccugcccugugggcgaggcccccucuccuuacaauucccgcuuugaaagcgucgcuugguccgccucugcuugucacgaugggacaagcuggcugaccauuggaaucuccggccccgacaacggggccguggcgguucugaaguauaauggaauuaucacggauaccaucaagagcuggagaaacuacauucuccggacacaggagucugagugcgccugugugaauggcuccugcuucaccgucaugacagacgggccuagcaacggacaggcuucuuauaaaaucuuuaagauugaaaaaggcaagguggugaaaagcgucgagcuggaugccccgaauuaccauuaugaagaguguuccugcuaccccgacgcuggcgagaucaccuguguuugccgcgauaacuggcacgggucuaacagaccuugggugagcuucaaucagaaccuugaauaucaaauuggauacaucugcuccggcguguuuggggacacgccccggccuaaugauggaacaggcagcugugggcccgucucuccgaacggagccuacggcgugaagggcuucuccuuuaaguaugggaauggaguuuggaucggccgcaccaaaagcacaaacucuagauccggguucgagaugauuugggacccuaauggauggaccggcaccgacagcuccuuuucugugaagcaggaucuggucgcgaucacagacuggagcggguacuccggcucuuucgugcagcaucccgaacucacgggacuggauugcauucggccuuguuucuggguugagcuuauccgcggcagacccaaagaaagcaccauuuggacauccgggagcucuaucuccuuuugcggagugaacagcgacaccgucggcuggucuuggcccgauggggccgagcugccuuucacaauugacaaguga

SEQ ID NO: 209210 - RNA, 1413 nt, Artificial Sequence
  derived and/or modified sequence opt5 from neuraminidase__InfluenzaA__BAM85830
augaaccccaaucagaagaucauuaccaucggcagcauuugcauggccaucgggacaauuucccugauccuccaaaucggaaacauuaucucuauuuggaucagccacuccauucagacgggcucucagaaucauaccgggaucuguaaccagagaauuaucacauacgagaauaacaccugggugaaucaaacauaugucaacaucagcaauaccaacguuguggcuggaaaagacacaaccuccaugauucuggccggcaauucuagccuuugcccuauccgggggugggcgauuuacuccaaggauaacagcauccgcauuggaucuaaaggcgacguguucgucaucagagaaccguuuaucuccuguagccaccuggagugccggacguucuuucucacccagggcgcucugcuuaaugauaagcauucuaacgggacagugaaagaccgcucccccuauagagcccugaugagcuguccuauuggagaagcccccucuccuuacaauucccgguucgagagcguugcuugguccgccucugcuugccacgauggcaugggguggcucaccaucggaauuagcggccccgacgauggggccguggcgguccugaaguauaacggaaucauuacagaaaucaucaaguccuggcgcaaacagauucugagaacccaggagagcgagugugugugcguuaacggcucuuguuuuacgaucaugacagacggcccuuccaaugggccggccagcuaccggauuuucaagaucaaaaagggaaaaauuaccaagucuaucgaacucgaugcucccaacagccauuaugaggaaugcuccuguuacccugacacaggcaaggugaugugcgucugccgcgauaauuggcacgggucuaacagacccugggugagcuuuaaucaaaaccuggacuaccagauuggauauaucuguuccggcguguucggggauaauccucggcccaaagacggaaagggcagcugcgacccggucaacguugauggcgccgacggggugaaaggauuuucuuaccgcuauggcaaugggguguggaucggaagaaccaaguccaacagcucucggaaaggcuucgagaugauuugggauccuaauggguggaccgacacagauggcaacuuucuugucaagcaggacgugguugcuaugacggauugguccggauacagcggcuccuucgugcagcaccccgagcugaccgggcucgacuguaugcgcccuugcuuuugggucgaacugaucagaggacaaccccgggagaaaacaaccauuuggacaucuggcagcuccaucucuuucuguggggugaauagcgauaccguuaacugguccuggcccgacggagccgaacuuccuuucacgauugauaaguga

SEQ ID NO: 209211 - RNA, 1413 nt, Artificial Sequence
  derived and/or modified sequence opt5 from neuraminidase__InfluenzaA__BAM85831
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaucggguggcugaccauuggaaucagcggcccugacaacggggcggucgccgugcugaaauauaacggaauuaucacagaaaccauuaagucuuggaaaaagcagauccucagaacgcaggaguccgagugcguuugugugaauggcagcugcuuuacaaucaugaccgauggccccucuaacggggcugccagcuacaaaauuuucaagaucgaaaagggaaaagucacaaaguccauugagcugaaugcuccuaacuuucacuaugaagaguguucuugcuacccggacaccggcaccgugaugugugugugccgggauaauuggcacgggagcaaccgccccugggucuccuucaaucagaaccuugacuaccaaaucggauauauuugcagcggcguuuuuggggauaauccuagaccccgggacggagagggcucuuguaacccugugacagccgauggcgcgaauggggugaaaggauucuccuacaaguauggcaacggggucuggaucggacgcacgaaaagcaauagacugcggaagggcuuugaaaugauuugggaccccaacggguggaccgacacagauucugacuucuccgugaaacaggauguuguggccaucaccgacuggagcggcuacuccggaucuuuuguccagcauccggagcucacaggccuggggugcauccgcccuuguuucuggguggaacuuguuagaggacugccccgggagaauaccacgauuuggacaagcggcuccucuaucagcuucugcggggugaacuccgauaccgcuaacuggagcuggccugacggagccgaacuccccuuuaccauugauaaguga

SEQ ID NO: 209212 - RNA, 1413 nt, Artificial Sequence; identical to SEQ ID NO: 204532
  derived and/or modified sequence opt5 from neuraminidase__InfluenzaA__BAM85832

SEQ ID NO: 209213 - RNA, 1410 nt, Artificial Sequence
  derived and/or modified sequence opt5 from neuraminidase__InfluenzaA__BAM85833
augaaccccaaucagaagaucauuaccaucggcagcacaugcauggugauugggaucauuucccugauccuccaaaucggaaacauuaucucuauuugggucagccacuccauccagacgggcaaucagaaccagccugagaccuguaaucaaucuguuauuacauacgaaaacaaaaccugggugaaucagacauaugugaacaucagcaauaccaaccuggucauugagagagacgugaucuccguugcccuucugggaaauucuagccucugcccgaucuccgggugggcuauuuacagcaaggauaacggcauccggauugggucuaaaggagacguguucgucauccgcgaacccuuuauuuccuguagccaucuggagugcagaacauucuuucuuacccagggcgcccugcucaaugauaagcacucuaacggcacggugaaagaccgguccccuuaucgcacccugaugagcugucccguuggggaagcgccuucucccuacaauuccagauucgagagcguggcuugguccgccucugccugccaugauggaaucagcuggcugacagucggcaucuccgggccugacaacggagcuguggccgugcucaaguauaacggcauuaucaccgauacagucaagagcuggcggaauaacauucugcgcacccaggagucugaaugugcuugcaucaauggguccuguuuuacgauuaugacagacggaccgagcaacggccaagccucuuacaaaaucuucaagaucgagaaaggcaagguugugaaaagcguggaacuuaaugcgcccaacuaucacuacgaggagugcuccuguuacccugaugccucugaaauuaugugcgucugcagagacaauuggcaugggagcaaccggcccuggguguccuuuaaucgcaaccuggaguaucagaucggauacauuuguagcggcguuuucggggauaauccuagacccaacgacggaaccggcucuugcgggccgguguccagcaauggagcuuauggcgucaagggcuuuucuuucaaguacgggaaaggaguguggaucggccggacaaaguccaccagcucccgcucuggguuugaaaugauuugggauccuaacggauggaccgagacagacagcuccuucucuguuaaacaggacaucguggccauuacggauuggagcggcuauuccgggagcuuuguccagcaccccgaacucaccggccuggacuguaucagaccuugcuucuggguggagcuuauccggggacgccccaaggagaauacaauuuggaccucuggcuccagcaucucuuucuguggggucaacuccgauacagugggauggagcuggcccgacggcgcugaacugccuuuuaccauugauaaauga

SEQ ID NO: 209214 - RNA, 1410 nt, Artificial Sequence
  derived and/or modified sequence opt5 from neuraminidase__InfluenzaA__BAM85834
augaaccccaaucagaagaucauuaccaucggcagcgugucccugacagucgccacgguuugcuuccucaugcaaauugcuauccugaccacaaccgugacacuucacuuuaaacagaacgaguguucuauuccugccaauaaccaggugaugccgugcgaacccaucgucaucgagagaaauauuaccgaaaucguguaccugaacaauacaaccauugagaaggaaaucugucucaaagcggcugaguaucggaacuggagcaagccucagugccaaauuacgggguucgcccccuuuuccaaagacaauucuauccgccugagcgccggaggcgauauuuggguuaccagagagccuuacguguccugugaccccucuaagugcuaucaguucgcucuugggcagggaacaacccuggaaaacaagcauagcaauggcacaauccacgaucggaucccucaucgcacccuccugaugaacgagcugggggucccguuucaccucggaacgaaacagguguguauugccugguccuccucuuccugccaugacggcaaggcuuggcugcacguuugugugacaggcgaugacagaaaugccaccgcgagcuucaucuacgaugggaugcuugucgacucuauuggauccuggagccaaaacauccugcggacacaggaaucugagugcguguguauuaaugggaccugcgccguggucaugaccgauggcuccgcuagcggacgcgccgacacaagaauccucuuuauccgggagggcaaaauuguucacaucagcccccugucugggagcgcucagcauauugaagagugcuccuguuauccucgcuaccccaucauuagaugcgugugucgggauaacuggaagggaagcaaccgcccugugaucgacaucaauauggccgauuauucuauugacuccagcuacgucugcucuggccuugugggcgacacgcccagaaacgaugacagcuccucuagcuccaauugucgggauccgaacaaugaacgcgggaacccuggaguuaaaggcugggcguucgacaaugggaacgauguguggaugggaagaaccaucagcaaggacucucgguccggcuacgagacauuuagagucauugggggaugggccaccgcuaauagcaagucucagacaaaccgccaagugaucguugauaauaacaauugguccggcuauagcggcauuuucuccguggaaucuaaaagcugcaucaaccgguguuuuuacgucgagcugauuagagggcgcccccaggagacccgggugugguggacguccaauucuaucgucguguucugcggaacaagcggcaccuaugggaccggauccuggccugacggcgccaacaucaacuuuaugcccauuuga

SEQ ID NO: 209215 - RNA, 1410 nt, Artificial Sequence
  derived and/or modified sequence opt5 from neuraminidase__InfluenzaA__BAM85835
augaaccccaaucagaagaucauuaccaucggcagcgugucccugacaauugccacggucugcuuccucaugcaaaucgcuauucuggccaccacaguuacccuucacuuuaaacagaacgaguguucuaucccugcgaauaaccagguggugccgugcgaacccaucauuaucgagagaaauauuacagaaaucgucuaccugaacaauaccacaauugagaaggaaaucuguagcaaagcuguggacuaucggaacugguccaagccucagugccaaauuaccggguucgcccccuuuucuaaagauaauagcauccgccucuccgccggaggcgacaucuggguuacgagagagccuuacgugucuugugauaccagcaagugcuaucaguucgcucuggggcagggaacaacccuugacaacaagcauuccaauggcacaauucacgaucggaucccccaucgcacccugcucaugaacgagcugggggucccuuuucaccugggaacgaaacagguguguauugccuggucuagcuccagcugccaugacggcaaggcuuggcuccacguuugugugacaggcgaugacagaaaugccaccgcgucuuucaucuacaacgggaugcuggucgauuccauuggaagcuggucucaaaauauccuucggacacaggaauccgagugcguguguaucaacggcagcugcaccguggucaugaccgacggguccgccucuggaaaagcugauacacgcauucuguuuguuaaggaaggcaaaaucauucacaucagcccgcucuccgggagcgcccagcauauugaggagugcucuuguuaucccagauacccuaacgugcggugcgugugucgcgacaauuggagaggauccaaccggcccgucaucgauaucaauauggcugacuauagcauugacucuagcuacgugugcuccggccugguuggcgauacgccucgcaacgacgauaauucuagcuccagcaacuguagagaccccaauaacgaacgggggaauccgggagugaagggcugggccuucgauucuggggacgaugucuggaugggacgcaccaucuccagagacagccggucuggcuacgagacauuuaaggugauugggggaugggcgaccgccaacuccaaaagccagacauccagacaaguuaucguggauaauaacaauuggucuggcuauagcggcgucuucuccguggaacacaagucuugcauuaaccgcuguuuuuacgucgagcuuauccgggggagaccucaggaaacccgcgugugguggacgagcaauuccauuguuguguucugcggaacaagcggcaccuaugggaccggaucuuggcccgacggcgcuaacaucaacuuuaugccuaucuga

SEQ ID NO: 209216 - RNA, 1410 nt, Artificial Sequence
  derived and/or modified sequence opt5 from neuraminidase__InfluenzaA__BAM85836
augaaccccaaucagaagaucauuaccaucggcagcgugucccugacaauugccacgaucugcuuccucaugcaaauugcuauccuggccaccacagucacccuucacuuuaaacagaacggguguucuaucccuagcaauaaccagguugugccgugcgagcccauuaucguggaaagaaauauuacagagaucgucuaccugaacaauaccacaauugaaaaggagcucuguccuaaagugcuggaauaucgggacugguccaagccccagugccaaaucaccggauucgcgccuuuuucuaaagauaacagcauucgccuuuccgcuggcggggacaucuggguuacgagagagcccuacgugucuuguagcccugauaagugcuaucaguucgcccugggacagggcaccacacucgacaaucggcauuccaacgggaccauccacgaucgcauuccgcauagaacacugcugaugaaugagcucggaguccccuuucaccugggcaccaaacagguguguaucgccuggucuagcuccagcugccaugacggccgggcuuggcuucacguuugugugacgggggaugaccgcaacgccacagcuucuuucauuuacgauggaaugcuggucgacuccaucggcagcuggucucaaaauauucucagaacccaggaauccgagugcguguguaucaacgggacaugcaccguggucaugaccgauggaagcgccuccggccgggcggacacacgcauccuguuuguuaaggaagggaagauugugcacaucucuccucuuagcggauccgcccagcauauugaggagugcagcuguuaucccagauacccugaugugcggugcgucugucgcgacaauuggaaaggcucuaacagacccaucauugacaucaacauggcugauuauuccaucggcagcucuuacgugugcagcgggcugguuggagacacgccgcggaaugaugacuccucuagcaacuccaauugucgcgauccuaacaaugaaagaggcaaccccggggugaagggaugggccuucgacuacggcaaugaugucuggauggggcggaccauuagcaaagacucuagauccggauaugagacauuucgcgugaucggcggcuggaccacagcuaacagcaagucucagguuaaucggcaagugauugucgauaacuccaauuggagcggguacuccggaaucuucucuguggaaggcaagagcugcauuaacagauguuuuuaugucgagcucauccgcgggcggccucaggaaaccagagugugguggacguccaauucuauuguuguguucugcggaacaagcggcaccuacgggaccggcuccuggcccgacggagccaacaucaauuuuaugcccaucuga

SEQ ID NO: 209217 - RNA, 1410 nt, Artificial Sequence
  derived and/or modified sequence opt5 from neuraminidase__InfluenzaA__BAO79717
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagagggaggacacggcgugaaagggugggccuucgaugacggaaacgauguuuggaugggccgcacgaucaaugaaacaagcagacugggguaugagaccuuuaaggugaucgagggauggucuaaccccaaauccaagcuccagauuaaucggcaggucaucguggaccgcggcgauagaagcggcuacucugggauuuucuccgucgaagggaaaaacuguaucaaucggugcuuuuauguggagcugauuagaggccgcaaggaagagaccgaaguucuguggacaagcaacuccaucguggucuucugugggaccucuggaacauacggcacggggagcuggccugacggcgcugaucucaaucugaugcccauuuga

SEQ ID NO: 209218 - RNA, 1413 nt, Artificial Sequence; identical to SEQ ID NO: 198083
  derived and/or modified sequence opt5 from neuraminidase__InfluenzaA__CAA33354

SEQ ID NO: 209219 - RNA, 1404 nt, Artificial Sequence
  derived and/or modified sequence opt5 from Neuraminidase__InfluenzaA__CAB95858
augaaccccaaucagaagaucauugcccugggcagcguguccaucaccauugcuacaaucugccuccugaugcaaauugccauccuugcgacgaccaugacacugcacuucaacgaguguaccaauccuucuaacaaucaggcuaugccgugcgaacccaucauuaucgagagaaacauuacagaaaucguccaucucaauaacaccacaauugagaaagaaagcuguccuaagguugccgaguacaaaaauugguccaagccccagugccagaucaccggguuugccccuuucucuaaagacaacagcauucggcuguccgcuggaggcgauaucugggugacgcgcgagcccuaugugucuugugggcuuggaaauugcuaccaauuugcccugggccaggggaccacacucaacaauaagcacagcaacggaaccauccaugacagauccccucaccggacacugcugaugaaugaacucggcgucccguuccaucugggcaccaaacagguguguauugcuuggucuagcuccagcugccacgaugggaaggccuggcuucacguuugugugacgggagacgaucgcaacgcgacagccucuaucauuuaugacggcaugcugaccgauuccaucgggagcuggucuaagaacauucucagaacacaggaguccgaaugcgucuguaucaauggaaccugcaccgugguuaugacagacggcagcgcuuccgggcgggccgauacgaaaauccuguuuauucgcgagggaaagaucgugcauauuucuccccuuagcggcuccgcucaacacgucgaggaaugcagcuguuacccuagauaucccgaggugcggugcgugugucgcgacaacuggaaaggcucuaauagaccuguccuguacaucaacguugccgauuauuccguggacagcucuuacgugugcagcgggcucgucggagauacaccccggaaugacgacuccucuagcuccagcaacugucgcgauccgaauaacgaaagaggcgggccuggagugaagggcugggcguucgacaaugggaacgauguuuggaugggacggaccauuaagaaagacucucgcuccggcuacgagaccuuuagaguggucggcggguggacaaccgccaauagcaagucucagaucaacagacaggugaucguugauuccgacaauuggagcggauauuccggcauuuucucuguggaagggaaaacgugcaucaaccgguguuuuuacgucgagcugauucgcggacggccccaggagacaagagugugguggaccagcaauuccaucauugucuucugcggcaccucugggacauauggcaccggaagcuggccugauggcgcuaacaucaacuuuauguccauuuga

SEQ ID NO: 209220 - RNA, 1404 nt, Artificial Sequence
  derived and/or modified sequence opt5 from neuraminidase__InfluenzaA__CAB95859
augaaccccaaucagaagaucauugcccugggcagcguguccaucaccauugcuacaaucugccuccugaugcaaauugccauccuugcgacgaccaugacacugcacuucaacgaguguaccaauccuucuaacaaucaggcugucccgugcgaacccaucauuaucgagagaaacauuacagaaaucguucaucucaauaacaccacaauugagaaagaaagcuguccuaagguggccgaguacaaaaauugguccaagccccagugccagaucaccggguuugccccuuucucuaaagacaacagcauucggcuguccgcuggaggcgauaucugggugacgcgcgagcccuaugucucuugugggcuuggaaagugcuaccaauuugcccugggccaggggaccacacucaauaacaagcacagcaauggaaccauccaugacagauccccucaccggacacugcugaugaacgaacucggcgugccguuccaucugggcaccaaacagguuuguauugcuuggucuagcuccagcugccacgaugggaaggccuggcuucacgugugugucacgggagacgaucgcaaugcgacagccucuaucauuuaugacggcaugcugaccgauuccaucgggagcuggucuaaaaacauucucagaacacaggaguccgaaugcguguguaucaacggaaccugcaccguugugaugacagacggcagcgcuuccgggcgggccgauacgaagauccuguuuauucgcgagggaaaaaucguccauauuggcccccuuucuggcagcgcucaacacguggaggaaugcuccuguuacccuagauaucccgaggugcggugcgucugucgcgacaauuggaaggggagcaacagaccuguucuguacaucaauguggccgauuauucuguggacuccagcuacgucugcucuggacucgugggcgauacaccccggaacgacgacagcuccucuagcuccaauugucgcgauccgaacaaugaaagagggggaccuggcguuaaggggugggcguucgacaacggaaaugauguguggaugggccggaccauuaaaaaggacagccgcucuggcuacgagaccuuuagagucgugggaggguggacaaccgccaacuccaaaagccagaucaaucggcagguuaucguggauucugacaacugguccggcuauagcgggauuuucuccgucgaaggaaagacgugcaucaauagauguuuuuacguggagcugauucgcggccggccccaggagacaagagucugguggaccucuaacagcaucauuguguucugcgggaccuccggcacauauggaaccggcucuuggccugauggggcuaauaucaacuuuaugagcauuuga

SEQ ID NO: 209221 - RNA, 1410 nt, Artificial Sequence; identical to SEQ ID NO: 197597
  derived and/or modified sequence opt5 from Neuraminidase__InfluenzaA__CAC19707

SEQ ID NO: 209222 - RNA, 1410 nt, Artificial Sequence
  derived and/or modified sequence opt5 from neuraminidase__InfluenzaA__CAD29959
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucaacccuaauaacgaggaaggaggccacggggugaaaggaugggcuuucgacgauggcaaugacguuuggauggggcggaccaucuccgagaagcugcgcagcggauacgagacguuuaaagugauugaaggcuggucuaagcccaacuccaaacugcagaucaauagacaggucaucguggaucggggcaaccgcagcggguauucuggaauuuucuccgucgagggcaagagcugcaucaauagauguuuuuacguggaacucauucgggggagaaagcaggagacagaaguucuguggaccuccaacucuaucguggucuucugcggaaccagcggcacauaugggaccggcuccuggccugacggagccgauauuaaucuuaugcccaucuga

SEQ ID NO: 209223 - RNA, 1410 nt, Artificial Sequence
  derived and/or modified sequence opt5 from neuraminidase__InfluenzaA__CAD29960
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaacaucaccggguucgcgcccuuuagcaaagacaauuccauucgccuuucugcuggaggcgauaucugggucacaagagagccuuaugugagcugugacccggauaagugcuaccaauucgcccuggggcagggaaccacacucaacaauggccauuccaacgacaccguucacgugcggacgcccuaucgcacacugcugaugaaugaacucggggucccuuuucaucugggaaccaaacagguguguaucgccuggucuagcuccagcugccacgauggcaaggcuuggcuucauguuugugugacaggcgacgaugagaacgccaccgcuucuuucauuuacaaugggagacuggucgacuccaucggaagcuggucuaagaaaauucuccggacccaggaauccgagugcguguguaucaacggcacaugcacgguggucaugaccgaugggagcgccucuggaaaggcggacacaaaaauucuguuuaucgaggaaggcaagaucguucacaccagcccccuuuccggguccgcccaacacguggaggaaugcucuuguuauccucgcuaccccggagugagaugcgucugucgggauaacuggaagggcagcaaucgcccgauuguggacaucaacguuaaagauuacuccauugugagcucuuaugucugcuccggccuggugggggacacaccuagaaagaaugacagcucuagcuccucucauugucucaaccccaauaacgaggaaggaggccacgggguuaaaggaugggcuuucgaugacggcaaugauguguggauggggcggaccaucagcgagaagcugcgcuccggauacgagacguuuaaagucauugaaggcuggagcaagccuaacucuaaacugcagaucaauagacaggugaucgucgaccggggcaaccgcuccggguauagcggaauuuucucuguggagggcaaguccugcaucaauagauguuuuuacguugaacucauucgggggagaaagcaggagacagaagugcuguggaccagcaacuccaucgucguguucugcggaaccucuggcacauaugggaccggcagcuggcccgauggagccgacauuaaucuuaugcccaucuga

SEQ ID NO: 209224 - RNA, 1410 nt, Artificial Sequence
  derived and/or modified sequence opt5 from neuraminidase__InfluenzaA__CAD29961
augaaccccaaucagaagaucauuaccaucggcagcgugucccugacaauuucuacgaucugcuucuuuaugcaaauugccauccucgucaccacaguuacccugcacuucaaacaguacgaguguaacagcccuccgaauaaccaggugaugcuuugcgaacccacaaucauugagagaaauaccacagaaaucguguaucugaccaacacgaccauugagaaggaaaucuguccuaaacucgcugaguaccggaauugguccaagccccagugcaacauuacaggguuugccccuuucucuaaagacaauagcauccgccuguccgcgggaggcgauauuugggucaccagagagcccuaugugucuugugacccugauaagugcuaccaauuugcucuugggcagggaacaacccugaacaauggccauagcaacgacacgguucacgaucggacaccguaucgcacccuccugaugaaugaacugggggugcccuuccaucucggaacaaagcaggucuguaucgccugguccucuagcuccugccacgacggcaaagccuggcugcauguguguguuaccggcgaugacgagaacgcuaccgccagcuuuaucuacaaugggagacuuguggauucuauuggauccuggagcaagaaaauccugcggacacaggaaucugagugcgucuguauuaacggcacgugcaccguggugaugacagacggguccgcuagcggaaaggccgauaccaaaauccucuucauugaggaaggcaagaucguccacacauccacccugucugggagcgcgcaacacguugaggaaugcuccuguuauccucgcuaccccggagugagaugcgugugucgggacaacuggaagggcagcaaucgcccuaucgucgauauuaacaucaaagacuacucuauuguguccagcuauguuugcucuggccuugugggggacacgcccagaaagaaugauagcuccucuagcucccauugucuggacccgaacaaugaggaaggaggccacggggucaaaggaugggccuuugaugacggcaacgauguguggauggggcggacaaucagcgagaagcuccgcucuggauacgagaccuucaaaguuauugaaggcugguccaagccuaauagcaaacugcagaucaacagacaggugaucgucgaccggggcaaucgcucuggguauuccggaauuuuuagcguggagggcaaguccugcaucaacagauguuucuacgucgaacugauucgggggagaaagcaggagaccgaagugcucuggacaucuaauagcaucguuguguuuugcggaaccuccggcacauaugggacgggcucuggacccgauggcgcugacauuaaccugaugccuaucuga

SEQ ID NO: 209225 - RNA, 1410 nt, Artificial Sequence; identical to SEQ ID NO: 204569
  derived and/or modified sequence opt5 from neuraminidase__InfluenzaA__CAD29962

SEQ ID NO: 209226 - RNA, 1410 nt, Artificial Sequence; identical to SEQ ID NO: 197308
  derived and/or modified sequence opt5 from neuraminidase__InfluenzaA__CAD29963

SEQ ID NO: 209227 - RNA, 1410 nt, Artificial Sequence; identical to SEQ ID NO: 197308
  derived and/or modified sequence opt5 from neuraminidase__InfluenzaA__CAD29964

SEQ ID NO: 209228 - RNA, 1410 nt, Artificial Sequence; identical to SEQ ID NO: 197308
  derived and/or modified sequence opt5 from neuraminidase__InfluenzaA__CAD29965

SEQ ID NO: 209229 - RNA, 1410 nt, Artificial Sequence; identical to SEQ ID NO: 197308
  derived and/or modified sequence opt5 from neuraminidase__InfluenzaA__CAD29966

SEQ ID NO: 209230 - RNA, 1410 nt, Artificial Sequence; identical to SEQ ID NO: 197064
  derived and/or modified sequence opt5 from neuraminidase__InfluenzaA__CAD29967

SEQ ID NO: 209231 - RNA, 1410 nt, Artificial Sequence; identical to SEQ ID NO: 197064
  derived and/or modified sequence opt5 from neuraminidase__InfluenzaA__CAD29968

SEQ ID NO: 209232 - RNA, 1410 nt, Artificial Sequence; identical to SEQ ID NO: 197597
  derived and/or modified sequence opt5 from neuraminidase__InfluenzaA__CAD29969

SEQ ID NO: 209233 - RNA, 1410 nt, Artificial Sequence
  derived and/or modified sequence opt5 from neuraminidase__InfluenzaA__CAD29970
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacccugggauccgcugcguguguagagacaauuggaagggauccaaccggcccauuguggauaucaacgucaaagacuacagcauugugucuuccuauguuugcagcggccuggugggcgacaccccgcgcaagaaugauucuagcuccucuagccacugucucaacccuaauaacgaggaagggggacauggcgucaaagggugggcuuucgacgauggaaaugacguguggaugggcagaacaaucuccgagaagcugcggagcggguacgagaccuuuaaaguuaucgaaggauggucuaagcccaacuccaaacugcagauuaaucgccaggugaucgucgauagaggcaaccggagcggcuauucugggauuuucuccguggagggaaagagcugcaucaauagauguuuuuacgucgaacucauucgcggccggaagcaggagacggaagugugguggacauccaacucuaucguuguguucugcgggaccagcggaaccuauggcacaggguccuggccugacggcgccgauauuaaucugaugcccaucuga

SEQ ID NO: 209234 - RNA, 1410 nt, Artificial Sequence; identical to SEQ ID NO: 199579
  derived and/or modified sequence opt5 from neuraminidase__InfluenzaA__CAD29971

SEQ ID NO: 209235 - RNA, 1410 nt, Artificial Sequence
  derived and/or modified sequence opt5 from neuraminidase__InfluenzaA__CAD29972
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaacaucaccggguucgccccuuuuuccaaagacaauucuauucgccuuagcgcgggaggcgauaucugggugacaagagagcccuauguuuccugugacccugauaagugcuaccaauucgcucuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaagccuggcuucauguuugugugacaggcgaugacaagaacgcuaccgccuccuucauuuacaaugggagacuggucgauagcaucggaucuugguccaaaaagauucuccggacccaggagagcgaaugcguguguaucaacggcacaugcgcuguggucaugacggacgggucugccuccggaaaagcggauaccaagauucuguuuaucgaggagggcaagaucgggcacacaagccuucuguccggaucugcccaacacguugaagagugcagcuguuauccucgcuaccccggcgugagaugcgugugucgggacaacuggaaaggcuccaaucgcccuauugucgauaucaacgugaaggacuacagcauuguuucuuccuaugugugcagcgggcucgucggagacacccccagaaagaaugauucuagcuccucuagccauugucuggacccgaacaaugaagagggcgggcacggagugaagggcugggcuuucgaugacgggaacgauguuuggaugggacggacaaucuccgaaaaacugcgcagcggcuacgagaccuuuaaggugauugagggcuggucuaaaccuaauuccaagcuccagaucaacagacaggucaucguggaccgggggaaucgcagcggauauucuggcauuuucuccgucgaaggaaagagcugcaucaacagauguuuuuacguggagcugauucgggggagaaaucaggaaacggagauccuuuggacauccaacucuauuguuguguucugcggcaccagcgggaccuauggcacaggauccuggcccgauggcgccgacaucaaucugaugccuauuuga

SEQ ID NO: 209236 - RNA, 1410 nt, Artificial Sequence
  derived and/or modified sequence opt5 from neuraminidase__InfluenzaA__CAD29973
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaagauucuccgcacccaggaaagcgagugcgucuguaucaacggcacaugcacgguggugaugaccgaugggucugccuccggacgcgcggacacaaaaauucuguuuaucgaggaaggcaagaucguccacauuagcccucuuuccgggucugcccaacauguugaggaaugcagcuguuauccccgguacuccggagugcgcugcguguguagagauaauuggaagggcagcaaccggccuaucgucgacauuaacgugaaagauuacucuaucguuuccagcuaugugugcucuggccuggucggggacacccccagaaagaaugacagcuccucuagcucccacugucucaacccgaauaacgaggaaggaggccauggggugaaaggaugggcuuucgaugacggcaaugauguuuggauggggagaacaauuagcgagaagcugcggucuggauacgagaccuuuaaagugaucggcggcugguccaagccuaacagcaaacugcagaucaaucgccaggucauuguggacagagggaaccggucuggauauuccggcaucuucagcgucgaagggaaguccugcauuaauagauguuuuuacguggagcucauccgcggacggaagcaggaaacggagguuugguggacaucuaacagcauuguggucuucugcggcaccuccgggaccuauggcacaggaucuuggcccgauggcgccgacaucaaucugaugccuauuuga

SEQ ID NO: 209237 - RNA, 1410 nt, Artificial Sequence; identical to SEQ ID NO: 205608
  derived and/or modified sequence opt5 from neuraminidase__InfluenzaA__CAD29974

SEQ ID NO: 209238 - RNA, 1410 nt, Artificial Sequence
  derived and/or modified sequence opt5 from neuraminidase__InfluenzaA__CAD29984
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcauuauguguccugugaccgggauaagugcuaccaauucgcccuggggcagggaaccacacucaacaauggccacucuaacgacaccguucaugaucgcacgcccuauagaacacugcugaugaaugaacucggggugccuuuucaccugggaaccaagcaggucuguaucgccuggagcuccagcucuugccaucacggcaaagccuggcuucacguguguguuacaggcgacgaugagaacgcuaccgcuuccuucauuuacaaugggcggcugguggacagcaucggaucuugguccaagaaaauucuccgcacccaggaaagcgagugcgucuguaucaacggcacaugcacgguggugaugaccgaugggucugccuccggaaaggcggacacaaaaauucuguuuaucaaggagggcaagaucguccauaccagcucccuuucugggagcgcccaacacguugaagagugcuccuguuauccgagauaccccggagugcggugcgugugucgcgauaacuggaaaggcagcaauagaccuauugucgacaucaacgugaaggauuacucuauuguuuccagcuaugugugcucuggccuggucggggacacaccccggaaaaaugacagcuccucuagcucccauugucucgauccuaacaaugaagagggaggccacggggugaagggaugggcuuucgacgauggcaacgacguuuggauggggcgcaccaucagcgaaaaacugagaucuggauacgagacguuuaaggugauugagggcugguccaaagccaauagcaagcugcagaucaaccggcaggucaucguggaucgcggcaauagaucuggguauuccggaauuuucagcgucgaauccaagucuugcaucaaccgguguuuuuacguggagcucauuagaggccgcaaacaggaaacagagguucuguggaccagcaauuccaucguggucuucugcgggaccucuggaacauauggcaccgggagcuggcccgacggcgcugauauuaaccuuaugccgaucuga

SEQ ID NO: 209239 - RNA, 1410 nt, Artificial Sequence
  derived and/or modified sequence opt5 from neuraminidase__InfluenzaA__CAD29985
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccuggucggggacacacccagaaagaaugauucuuucagcuccucucauugucucgacccgaacaaugaggaaggaggccacggggugaaaggaugggcuuuugaugacggcaacgauguuuggauggggcggaccauuagcgagaagcugcgcuccggauacgagacguucaaagugaucgaaggcuggagcaagccuaauucuaaacugcagaucaacagacaggucauuguggagcggggcaaucgcuccggguauagcggaaucuuuucugucgaaggcaaguccugcauuaacagauguuucuacguggagcucauccgggggagaaaggaagagacagagguuugguggaccagcaauuccauuguggucuuuugcggaaccucucgcacauauggcaccgggagcuggcccgacggcgccgauaucaaccugaugccuauuuga

SEQ ID NO: 209240 - RNA, 1410 nt, Artificial Sequence
  derived and/or modified sequence opt5 from neuraminidase__InfluenzaA__CAD29988
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccgagaaagcggauacaaagauucuguuuaucgaagagggaaaaaucguccacauuagcacccuuuccggcucugcccaacacguugaagagugcagcuguuauccuagauaccccggggugcggugcgugugucgcgacaacuggaagggauccaauagaccuaucgucgauauuaacgugaaggacuacagcaucguuucuuccuaugugugcagcggccuggucggcgacacaccccggaaaaaugauucuuucagcuccucucauugucucgacccgaacaaugaagaagggggacacggcgugaaggggugggcuuuugaugacggaaacgauguuuggaugggccgcaccauuagcgagaaacugagauccggguacgagacguucaaggugaucgagggauggagcaaaccuaauucuaagcugcagaucaaccggcaggucauuguggaacgcggcaauagauccggcuauagcgggaucuuuucugucgagggaaaauccugcauuaaccgguguuucuacguggaacucaucagaggccgcaaggaggagacagaaguuugguggaccagcaauuccauuguggucuuuugcgggaccucuggaacauauggcaccgggagcuggcccgacggcgccgauaucaaccugaugccuauuuga

SEQ ID NO: 209241 - RNA, 1410 nt, Artificial Sequence
  derived and/or modified sequence opt5 from neuraminidase__InfluenzaA__CAD29990
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgggcggacgccguaucgcacacugcugaugaaugaacucggagugcccuuucaucugggcaccaagcaggucuguaucgccuggagcuccagcucuugccacgauggcaaagccuggcuucauguguguguuacaggggacgaugagaacgcuaccgcuuccuucauuuacaauggaagacugguggacagcaucggcucuugguccaagaaaauucuccggacccaggaaagcgagugcgucuguaucaacgggacaugcacgguggugaugaccgauggaucugccuccggcaaggcggacacaaaaauucuguuuaucgaggaagggaagaucguccacaccagccuucuguccggaucugcccaacacguugaggaaugcagcuguuauccucgcuaccccggcgugagaugcgugugucgggauaacuggaagggcuccaaucgcccuauugucgacaucaacgugaaagauuacagcauuguuucuuccuaugugugcagcgggcucgucggagacacacccagaaagaaugacaacucuagcuccucucauugucuggauccgaauaacgaggaaggcgggcacggagugaaaggcugggcuuucgacgaugggaaugacguuuggaugggacggaccaucagcgagaagcugcgcuccggcuacgagacguuuaaagugauugaaggcuggagcaagccuaacucuaaacuccagaucaauagacaggucaucguggaucgggggaaccgcuccggauauagcggcauuuucucugucgaggggaaguccugcaucaauagauguuuuuacguggaacugauucggggaagaaagcaggagacagaaguucuuuggaccagcaacuccaucguggucuucugcggcaccucugggacauauggcaccggaagcuggcccgacggcgccgauauuaaucugaugccuaucuga

SEQ ID NO: 209242 - RNA, 1410 nt, Artificial Sequence; identical to SEQ ID NO: 197085
  derived and/or modified sequence opt5 from neuraminidase__InfluenzaA__CAD29991

SEQ ID NO: 209243 - RNA, 1410 nt, Artificial Sequence
  derived and/or modified sequence opt5 from neuraminidase__InfluenzaA__CAD29992
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacagaagcauuguuucuuccuacgugugcagcggccucgucggggacacaccccggaagaaugauucuagcuccucuagccauugucuggacccgaacaaugaggaaggaggccacggggugaaaggaugggcuuucgaugacggcaacgauguuuggauggggcgcaccaucuccgagaagcugagaagcggauaugagacguuuaaagugauugaaggcuggucuaagccuaauuccaaacuccagaucaaccggcaggucaucguggaccgcggcaauagaagcggguacucuggaauuuucuccgucgagggcaagagcugcaucaaccgguguuuuuauguggaacugauuagagggcgcaagcaggagacagaaguucuuuggaccuccaauucuaucguggucuucugcggaaccagcggcacauacgggaccggcuccuggcccgauggagccgacauuaaccugaugccuaucuga

SEQ ID NO: 209244 - RNA, 1410 nt, Artificial Sequence
  derived and/or modified sequence opt5 from neuraminidase__InfluenzaA__CAD29993
augaaccccaaucagaagaucauuaccaucggcagcgugucccugacaauugccacgaccugcuuccucaugcaaaucgcuauucuggucacaaccguuacacuucacuuuaaacaguacgaguguaacucuccuccgaauaaccaggugaugcugugcgaacccaccaucaucgagagaaauauuacagaaaucguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaagccuggcuucauguguguguuaccggcgaugacgagaacgcuaccgcuuccuucaucuacaaugggagacugguggauagcauuggaucuugguccaagaaaauccuccggacacaggaaagcgagugcgucuguauuaacggcacgugcaccguggugaugacagacgggucugccuccggaaaggcggauaccaaaauccuguuuauugaggaaggcaagaucguccacacaagcccucuuuccgggucugcccaacacguugaggaaugcagcuguuauccccgcuacccuggagugagaugcgugugucgggacaacuggaagggcuccaaucgccccaucgucgauauuaacgugaaagacuacagcaucguuucuuccuaugugugcagcggccuggucggggacaccccgagaaagaaugauucuagcuccucuagccauugucucgacccuaacaaugaggaaggaggccacggggugaaaggaugggcuuucgaugacggcaacgauguuuggauggggcggacgauuuccgagaagcugcgcagcggauacgagacauuuaaagugaucgaaggcuggucuaagcccaauuccaaacugcagauuaacagacaggucaucguggaccggggcaaucgcagcggguauucuggaaucuucuccgucgagggcaagagcugcauuaacagauguuuuuacguggaacucauccgggggagaaagcaggagaccgaaguucuguggaccuccaauucuauuguggucuucugcggaacaagcggcaccuaugggacaggcuccuggccugauggagccgacaucaaccuuaugcccauuuga

SEQ ID NO: 209245 - RNA, 1410 nt, Artificial Sequence; identical to SEQ ID NO: 198773
  derived and/or modified sequence opt5 from neuraminidase__InfluenzaA__CAD29994

SEQ ID NO: 209246 - RNA, 1413 nt, Artificial Sequence; identical to SEQ ID NO: 199477
  derived and/or modified sequence opt5 from neuraminidase__InfluenzaA__CAD57252

SEQ ID NO: 209247 - RNA, 1413 nt, Artificial Sequence
  derived and/or modified sequence opt5 from neuraminidase__InfluenzaA__CAD57253
augaaccccaaucagaagaucauuaccaucggcagcauuagaaucgccauugggaucaucucccugaugcuccaaauuggaaacaucauuucuaucugggcuagccacuccauucagacaggcucucagaaucauacgggggugugcaaccagcggaucauuaccuacgagaauagcacaugggucaaccacaccuauguuaauaucaacaauacaaacgugaucgccggaaaagacaagaccuccgugacacuggcgggcaauucuagccuuuguuccauuagcgggugggcuaucuacaccaaagauaacucuauucgcaucggauccaagggcgacgucuucgugauuagagaaccuuuuaucagcugcucucaucuggagugucggacguucuuucucacccaaggcgcccugcuuaaugauaaacacuccaacgggacaguuaaggaccgcagcccguauagagcccugaugucuugcccccucggagaagcuccuucccccuacaauagcaaguucgaguccguggccuggucugcuagcgccugucaugauggcaugggguggcugaccaucggaauuuccggcccugacaacggggcggucgccgugcugaaauauaacggaaucauuacagaaaccaucaagagcuggaaaaagcagauucuccggacgcaggagucugagugcguuugugugaauggcuccugcuuuacaaucaugaccgauggccccagcaacggggcugccucuuacaaaaucuucaagauugaaaagggaaaaaucacaaagagcauugagcugaaugcuccuaacuuucacuaugaagaguguuccugcuacccggacaccggcaccgucaugugugugugccgcgauaauuggcacgggucuaacagacccugggugagcuucaaucagaaccuugacuaccaaaucggauauauuugcuccggcgucuuuggggauaauccucggcccaaagacggagagggcagcuguaacccuguuacaguggauggcgccaauggggugaagggauucucuuacaaauauggcaacggggucuggaucggacgcacgaaguccaauagacugcggaaaggcuuugaaaugauuugggaccccaacggguggaccgacacagauagcgacuucucugugaagcaggauguuguggcgaucaccgacugguccggcuacagcggauccuuuguccagcauccggagcucacaggccuggauugcauccgcccuuguuucuggguggaacuuguuagagggcugcccaaggagaauaccacgauuuggacaucuggaagcuccaucucuuucugcggcgugaacagcgacaccgccaacugguccuggccugauggggcugaacuccccuuuaccauugacaaauga

SEQ ID NO: 209248 - RNA, 1413 nt, Artificial Sequence; identical to SEQ ID NO: 197420
  derived and/or modified sequence opt5 from neuraminidase__InfluenzaA__CAD57255

SEQ ID NO: 209249 - RNA, 1413 nt, Artificial Sequence
  derived and/or modified sequence opt5 from neuraminidase__InfluenzaA__CAD57256
augaaccccaaucagaagaucauuaccaucggcagcauuuccguggccaucgggauuaucucucugaugcuccaaaucggaaacauuaucagcauuugggcuucccacucuauccagacaggcagccagaaucauacggggauuugcaaccagagaaucauuaccuacgagaauagcacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaauccuccggacgcaggaguccgagugcgugugugucaauggcagcugcuuuacaauuaugaccgauggccccucuaacggggcugccagcuaccgcaucuucaaaaucgaaaagggaagagugacaaaguccauugagcuggacgcuccuaauuaucacuacgaagaguguucuugcuacccggauaccggcaccgugaugugugucugccgggacaacuggcacgggagcaaucgccccuggguuuccuuuaaccagaaucuugauuaucagaucggauacauuugcagcggcguguucggggacaacccuagacccaaagauggagagggcucuuguaauccugugacagucgacggcgccgacggggugaagggauuuuccuauaaauacggcaacgggguuuggaucggacggacgaaguccaaucgccugagaaaaggcuucgaaaugauuugggaucccaacggguggaccgacacagauucugacuuuuccgugaagcaagaugucguggcgaucaccgacuggagcggcuauuccggaucuuucguucagcauccggagcucacaggccuggauugcauucggccuuguuuuuggguggaacuuguccgcgggagaccccgggagaauaccacgaucuggacaagcggauccucuaucagcuucugcggcgugaacuccgacaccgccaauuggagcuggccugauggggcugaacugcccuucaccauugacaaauga

SEQ ID NO: 209250 - RNA, 1413 nt, Artificial Sequence
  derived and/or modified sequence opt5 from neuraminidase__InfluenzaA__CAD57257
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacucucacuaugaagaguguagcugcuacccggacaccggcaccgugaugugugugugccgcgauaauuggcacggguccaacagacccugggucagcuuuaaucagaaccuugacuaccagauuggauauaucugcucuggcguuuucggggauaauccucggcccaaagacggagagggcuccuguaacccugugacaguggauggcgccgacggggucaagggauuuagcuaccgcuauggcaaugggguguggauuggaagaacgaaaucuaaccggcugcgcaagggcuucgaaaugaucugggaccccaauggguggaccgauacagacuccgauuuuagcaugaaacaagacguuguggcgaugaccgauugguccggcuacucuggauccuucguccagcauccggagcucacaggccuggacugcauuagaccuuguuuuuggguggaacuuguucgggggcgccccagagagaacaccacgaucuggacauccggaucuagcaucuccuucugcggcgugaauagcgauaccgccaacuggucuuggccugacggggcugaacugcccuucaccauugauaaguga

SEQ ID NO: 209251 - RNA, 1413 nt, Artificial Sequence
  derived and/or modified sequence opt5 from neuraminidase__InfluenzaA__CAD57258
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagagaauuaucaccuaugaaaauuccacaugggucaaccaaaccuacguuaauaucaacaauacaaacgugguggccggaaaagacaagaccucuaugguccuggcgggcaauagcucccuuuguccuauucgggggugggcuaucuauacaaaagauaacagcauucgcaucggaucuaagggcgacauuuucgugaucagagagccguuuaucuccugcagccaucuggagugucggaccuucuuucucacgcagggcgcccugcuuaaugauaaacacucuaacgggaccguuaaggaccgcucccccuacagagcccugaugagcugcccucucggagaagcucccucuccuuauaauucccgguucgagagcguggccugguccgcuucugccugucaugauggccugggguggcugacaauuggaaucagcggccccgacaacggggcggucgccgugcucaaguacaacggaauuaucaccgaaacaauuaaauccuggaagaaacagauccugcgcacccaggagagcgagugcguuugugugaauggcucuugcuuuacgaucaugacagauggcccuuccaacagagcugccagcuaucggauuuucaagaucgaaaaagggcgcgucaccaagucuauugagcuugacgcuccgaauuaccacuacgaagaguguagcugcuaucccgauacaggaaccgugaugugugugugcagagacaacuggcauggcuccaaucggccuugggucucuuuuaaccaaaaucuggauuaccagaucggguauauuugcagcggaguuuucggcgacaacccccgcccuaaggauggggagggauccuguaaucccgugaccguggacggcgccgacggcgucaaaggguuuagcuacagauauggaaacggcguguggaucgggcggacaaagucuaaucgccucagaaaaggauucgaaaugauuugggauccgaacggcuggacggacaccgauuccgacuuuagcaugaagcaggauguuguggcgaugacagacuggucuggguacuccggcagcuucguccagcacccugagcugaccggacuugauugcaugcggcccuguuuuuggguggaacugguuagaggccucccucgcgagaauacaaccaucuggacguccgggucuagcaucuccuucugcggagugaacucugaaacagccaauuggagcuggcccgacggcgcugagcugcccuucaccauugauaaauga

SEQ ID NO: 209252 - RNA, 1413 nt, Artificial Sequence
  derived and/or modified sequence opt5 from neuraminidase__InfluenzaA__CAD57259
augaaccccaaucagaagaucauuaccaucggcagcauuuccaucgccauugggaucaucucucugauucuccaaaucggaaacauuaucagcauuugggcuucccacucuauccagacagagagccagaaucauacgggcauuugcaaccagagaaucaucaccuacgaaaauuccacaugggugaaccaaaccuaugucaauauuaacaauacaaacguugccgcggggaaagacaagaccucuaugacacuggcuggaaauagcucccuuuguccuauccggggcugggccauuuacaccaaagauaacagcauccgcauugggucuaagggagacaucuucgugaucagagagccguuuauuuccugcagccaccuggaaugucggacguucuuucucacccagggcgcccugcuuaaugauaaacauucuaacggcacagugaaggaccgcucccccuauagagcucugaugagcugcccucucggggaggcccccucuccuuacaauucccgguucgaaagcgucgcuugguccgccucugcgugucacgauggacugggcuggcugaccaucgggauuagcggacccgacaacggcgccguggcuguucucaaguauaacgggaucauuacagagaccaucaaauccuggaagaaacgcauccugagaacgcaggagagcgaaugcguguguaugaauggaucuugcuuuacaauuaugaccgauggcccuuccaacggcgccgcuagcuaccggaucuucaagauugagaaagggcgcgucacaaagucuaucgaacuugacgccccgaauuaucauuacgaggaguguagcugcuaccccgaaaccggaaccgugauguguguuugcagagauaacuggcacggcuccaaucggccuugggugucuuuuaaccagaaucuggacuaucaaauuggguacaucugcagcggagucuucggcgauaacccccgcccuaaggacggggagggauccuguaaucccgugacaguggauggcgcggacggcgucaaaggguuuagcuauagauacggaaacggcguuuggauugggcggacgaagucuaaucgccucagaaaaggauucgaaaugaucugggacccgaacggcuggaccgauacagacuccgauuuuagcaugaagcaggacaucguggccaugaccgauuggucuggguauuccggcagcuucgugcagcacccugagcugacaggacuugacugcaugcggcccuguuuuugggucgaacuggugagaggccucccucgcgagaauaccacgauuuggacauccgggucuagcaucuccuucugcggaguuaacucugauaccgcuaauuggagcuggcccgacggcgccgagcugcccuucaccauugauaaauga

SEQ ID NO: 209253 - RNA, 1413 nt, Artificial Sequence
  derived and/or modified sequence opt5 from neuraminidase__InfluenzaA__CAD57264
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagagaauuaucaccuaugagaauagcacaugggugaaccaaaccuacguuaauaucaacaauacaaacgugguggccggaaaagacaagaccucuaugacacuggcgggcaauagcucccuuuguccuauucgggggugggcuaucuauaccaaagauaacagcauucgcaucggaucuaagggcgacgucuucgugauuagagaaccguuuaucuccugcagccaucuggagugucggacguucuuucucacccagggcgcccugcuuaaugauaaacacucuaacgggacaguuaaggaccgcucccccuacagagcccugaugagcugcccucucggagaagcucccucuccuuauaauucccgguucgagagcguggccugguccgcuucugccugucaugauggccugggguggcugaccaucggaauuagcggccccgacaacggggcggucgccgugcucaaguacaacggaaucauuacagaaaccaucaaauccuggaagaaacagauucugcgcacgcaggagagcgagugcguuugugugaauggcucuugcuuuacaaucaugaccgauggcccuuccaacggggcugccagcuauagaaucuucaagauugaaaaaggacgggucacaaagucuaucgagcuugacgcuccgaauuaccacuacgaagaguguagcugcuaucccgauaccggcaccgugaugugugugugccgcgacaacuggcauggguccaauagaccuugggucucuuuuaaccaaaaucuggauuaccagauuggauauaucugcagcggcguuuucggggacaacccccggccuaaggauggagagggcuccuguaaucccgugacaguggacggcgccaacggggucaaaggauuuagcuaccgcuauggcaaugggguguggauuggaagaacgaagucuaaccggcuccgcaaaggcuucgaaaugaucugggacccgaauggguggaccgauacagacuccgauuuuagcaugaagcaggacguuguggcgaugaccgauuggucuggcuacuccggauccuucguccagcacccugagcugacaggccuugacugcaugagacccuguuuuuggguggaacugguucgggggcucccuagagagaacaccacgauuuggacauccggaucuagcaucuccuucugcggcgucaauucugaaaccgccaacuggagcuggcccgauggggcugagcugcccuucaccaucgacaaauga

SEQ ID NO: 209254 - RNA, 1350 nt, Artificial Sequence
  derived and/or modified sequence opt5 from neuraminidase__InfluenzaA__CBW54819
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaucagcuggcugaccauuggaaucuccggcccugauaacggggccguugcggugcugaaguacaauggaauuaucacggacaccauuaagagcuggcggaacaauauccuccgcacacaggagucugagugugccugcgucaacggcuccuguuucaccgugaugacagaugggccgagcucuggacaggcuagcuauaaaaucuuuaagauggaaaaaggcaagguggucaaauccguugagcuggacgcccccaauuaccauuaugaagagugcucuuguuacccugaugcuggcgagauuaccugcgugugcagagacaacuggcacgggagcaaccggcccuggguguccuucaaucagaaccuugaauaucgcaucggauacauuuguagcggcgucuuuggggauaauccuagacccaacgacggaacgggcucuugcgggccgguguccccuaauggagccuacggcguuaagggcuucagcuuuaaguauggggauggaguguggaucggccggacaaaaucuaccaacucccgcagcggguucgagauggucugggaccccaauggauggacaggcaccgacuccucuuuuagcgugaagcaagauauuguugcgaucaccgacugguccggguacucuggcagcuucgugcagcacccugaacugacaggacucgauuguaucagacccugcuucugggucgagcugauucggggccgccccaaagaauccacgaucuggaccagcgggucuuccauuagcuuuuguggagugaacucugacacagucuccuggagcuggccugauggcgccgagcuuccguucaccaucgacaaguga

SEQ ID NO: 209255 - RNA, 1350 nt, Artificial Sequence
  derived and/or modified sequence opt5 from neuraminidase__InfluenzaA__CBW54821
augaaccccaaucagaagaucauuaccaucggcagcauuugcaucgugauugggaucgucucccugaugcuccaaaucggaaacaugauuucuaucuggguuagccacuccauucagacaggcaaucagugucaggccgagccuaucucuaacacgaaauuccugaccgaaaaggcuguggccagcgugacacuugcgggaaauuccucucugugcccgauuagcgggugggcugucuacuccaaagacaacagcaucagaauuggcucucgcggggauguguuuguuauccgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggauuagcuggcugaccaucggaauuuccggcccugauaacggggccguugcggugcugaaguacaauggaaucauuacggacaccaucaagagcuggcggaacaauauccuccgcacacaggagucugagugugccugcauuaacggcuccuguuucaccgucaugacagaugggccgagcucuggacaggcuagcuauaaaaucuuuaagauggaaaaaggcaagguggugaaauccgucgagcuggacgcccccaauuaccauuaugaagagugcucuuguuacccugaugcuggcgagauuaccugcguuugcagagacaacuggcacgggagcaaccggcccuggguguccuucaaucagaaccuugaauaucaaaucggauacauuuguagcggcguguuuggggauaauccucgccccaacgacggaacgggcucuugcgggccggucuccccuaauggagccuacggcgugaagggcuucagcuuuaaguaugggaacggaguuuggaucggcagaacaaaaucuaccaauucccggagcggguucgagaugaucugggaucccaacggauggacaggcaccgacuccucuuuuagcgugaagcaggacauugucgcgaucaccgauugguccggguacucuggcagcuucgugcagcacccugaacugacaggacucgacuguauucgccccugcuucuggguugagcugaucagaggccagcccaaagaauccacgauuuggaccagcgggucuuccaucagcuuuuguggagucaauucugauacaguguccuggagcuggccugacggcgccgagcuuccguucaccauugauaaguga

SEQ ID NO: 209256 - RNA, 1410 nt, Artificial Sequence
  derived and/or modified sequence opt5 from neuraminidase__InfluenzaA__CCG47912
augaaccccaaucagaagaucauuaccaucggcagcgugucccugacaauugccacgaugugccucuucaugcaaaucgcuauucugaucaccacagucacccuucacuuuaaacaguacgagugugacucuccugccaacaaucagguuaugccgugcgaacccaucauuaucgagaagaacauuacaaaaaucguguaucugaccaauacaaccauugaaaaggagguguguccuaaacucggggaauacagaaacuggagcaagccccagugccggaucacgggauucgcgccuuuuuccaaggauaauucuauucgccugagcgcuggcggggccaucugggucaccagagagcccuauguguccugugacccuaacaaaugcuaccaauucgcccuuggacagggcacaacccuggauaaucggcauucuaacgacacaauccacgaucgcaccccguauagaacgcuccugaugaaugagcuggggguucccuuucaucucggaacacgccagguguguauugcuuggagcuccagcucuugccacgacggcaaggccuggcugcaugucugugugaccggccacgauaaaaacgcuacagccuccuucaucuacgacgggaaacuuguugauagcauuucuuccuggagccagaauauccugcggacccaagaaucugagugcguguguauuaacggaaucugcaccgucgugaugacagacggcuccgcgagcgggaaggccgauacgaagauccucuuuauugaagagggaaaggugauccacauuuccccucugcuuggcucugcucagcaugucgaggaaugcagcuguuaucccagauacccugacguucggugcaucugucgcgauaauuggaaaggguccaacagacccauuguggacauccggaugaaggacuacagcaucggaucuuccuauaugugcagcggccuggugggcgauaccccgcgcaacaaugacgggucuagcaacuccaauuguagaaacccuaauaacgagcggggaaaucacggcgucaaagggugggccuucgaugacggaaacgauauuuggaugggccgcacaaucucuaaggacagcagacucggguacgaaaccuuuaaagugguuggaggcuggucccagcccaauagcaaguuccagauuaaccggcaagugaucgucgauucugacaauagauccggcuauagcgggaucuuuucuguggagggaaaauccugcauuaaccgcuguuucuacguugaacugauucggggcagacgccaggagacacgggugugguggaccagcaauuccaucgucguguuuugcgggacgucuggaacauauggcagcggguccuggccugauggcgcugacaucaacuucaugcccauuuga

SEQ ID NO: 209257 - RNA, 1353 nt, Artificial Sequence
  derived and/or modified sequence opt5 from neuraminidase_subtype_1__InfluenzaA__AAF74321
augaaccccaaucagaagaucauuaccaucggcagcauuugcaugguggucgggaucauuucccugaugcuccaaaucggaaacaucauuucuguuugggugagccacacaauccagacguggcauccuaaucagccggagcccuguaaccaguccauuaauuucuacaccgaacaagccgcugccucugugacacuggcgggcaacagcucccuuugcccuaucucugggugggcuauuuauagcaaagacaauuccaucagaauuggaagcaagggcgaugucuuugugauccgggagcccuucaucucuuguucccaccuggaaugccgcaccuuuuuccucacacagggggcccugcuuaacgacaaacauagcaauggaaccguuaaggauagaucuccuuaccggacacugauguccugucccgugggcgaggccccuagcccguauaacucucgcuuugaauccgucgcuuggagcgccuccgcuugccacgacggcauuucuuggcucaccaucgggauuagcggacccgauaauggcgccguggcgguucugaaauacaacgggaucauuacggacaccaucaaguccuggagaaauaacauccugcggacacaggagagcgagugugccugcgugaauggaucuuguuucaccgucaugacagauggcccuuccaacgaacaggcuagcuauaagauuuuuaaaaucgagaaggggcgcguggugaaaucugucgaacucaacgcccccaauuaccauuaucaagagugcagcuguuacccugacgcuggagagauuaccugcguuugcagagauaacuggcacggcuccaaucggcccugggugucuuucaaccagaaucuggaauaccagaucggcuauauuuguagcgggguguuuggagacuccccgcgcccuaacgauggcacggggagcugcggacccgucucucuuaauggcgccuacggggugaagggauucuccuuuaaauauggcaacggcguuuggaucgggagaacaaagagcaccucuucccggagcggauucgagaugaucugggacccuaauggcuggacagaaaccgauuccucuuuuagccugaagcaggacauuaucgcgauuaccgacugguccggguacucuggcagcuucauccaacaccccgagcucacaggacugaacuguaugcgccccugcuucuggguggaacuuauuagagggcggccuaaagagaagacgaucuggaccuccggcagcucuauuuccuuuuguggagucaauagcgauacagugggcuggucuuggccggacggggccgagcugcccuucaccaucgauaaauga

SEQ ID NO: 209258 - RNA, 1353 nt, Artificial Sequence
  derived and/or modified sequence opt5 from neuraminidase_subtype_1__InfluenzaA__AAF74322
augaaccccaaucagaagaucauuaccaucggcagcauuugcaugguggucgggaucauuucccugaugcuccaaaucggaaacacaaucucuguuugggugagccacauuaucaaaacguggcauccuaaucagccggagcccuguaaccaguccauuaauuucuacaccgaacaggccgcugccucugugacacuggcgggcaacagcucccuuugcccuaucucugggugggcuauuuauagcaaggacaauuccaucagaauuggaagcaaaggcgaugucuuugugauccgggagcccuucaucucuuguucccaccuggaaugccgcaccuuuuuccucacacaaggggcccugcuuaacgacaagcauagcaauggaaccguuaaagauagaucuccuuaccggacacugauguccugucccgugggcgaggccccuagcccguauaacucucgcuuugaauccgucgcuuggagcgccuccgcuugccacgacggcauuucuuggcucaccaucgggauuagcggacccgauaauggcgccguggcgguucugaaguacaacgggaucauuacggacaccaucaaguccuggagaaauaacacacugcggacccaggagagcgagugugccugcgugaauggaucuuguuucacagucaugaccgauggcccuuccaacgaacaggcuagcuauaaaaucuuuaagauugagaaagggcgcguggugaagucugucgaacucaacgcccccaauuaccauuaugaggagugcagcuguuacccugacgcuggagaaaucacgugcguuugcagagauaacuggcacggcuccaaucggcccugggugucuuucaaccagaaucuggaguaccaaauuggcuauaucuguagcgggguguuuggagacuccccgcgcccuaacgauggcacagggagcugcggacccgucucucuuaauggcgccuacggggugaaaggauucuccuuuaaguauggcaacggcguuuggauugggagaaccaagagcacaucuucccggagcggauucgaaaugaucugggacccuaauggcuggaccgagaccgauuccucuuuuagccugaaacaggacaucauugcgaucacagacugguccggguacucuggcagcuucauucagcaccccgaacucacgggacugaacuguaugcgccccugcuucuggguggagcuuaucagagggcggccuaaggagaaaaccauuuggacauccggcagcucuaucuccuuuuguggagucaauagcgauaccgugggcuggucuuggccggacggggccgaacugcccuucacaauugauaaguga

SEQ ID NO: 209259 - RNA, 1353 nt, Artificial Sequence
  derived and/or modified sequence opt5 from neuraminidase_subtype_1__InfluenzaA__AAF74323
augaaccccaaucagaagaucauuaccaucggcagcauuugcaugguggucgggaucauuucccugaugcuccaaaucggaaacaucauuucuguuuggaucagccacauuauccagacauggcauccuaaucagccggagcccuguaaccaguccauuaauuucuacacggaacaagccgcugccucugugacccuggcgggcaacagcucccuuugcccuaucucugggugggcuauuuauagcaaagacaauuccaucagaaucggaagcaagggcgauguguuugucauucgggagcccuucaucucuuguucccaccuggaaugccgcacauuuuuccucacccagggggcccugcuuaacgacaaacauagcaauggaacagugaaggauagaucuccuuaccggacccugauguccugucccguuggcgaggccccuagcccguauaacucucgcuuugaauccguggcuuggagcgccuccgcuugccacgacggcauuucuuggcucacaaucgggauuagcggacccgauaaugaggccgucgcggugcugaaauacaacggcaucaucaccgacacgauuagauccuggcggaauaacauccugcgcacccaggagagcgaaugugccugcguuaaugggucuuguuucacagugaugaccgauggaccuuccaacgagcaggcuagcuauaagauuuuuaagaucgaaaaaggcagagucgugaagucuguggagcucaacgcccccaauuaccauuaugaggaaugcagcuguuacccugacgcuggggagauuacaugcgucugccgggauaacuggcacggauccaaucgccccuggguuucuuucaaccaaaaucuggaauaccagaucggcuauaucuguagcggcguguuuggggacuccccgagaccuaacgauggaaccggcagcugcgggcccgugucucuuaauggagccuacggcgucaaaggguucuccuuuaaguauggaaacggcguguggauuggccggacgaaaagcacaucuucccgcagcggguucgagaugaucugggacccuaauggauggaccgaaacagauuccucuuuuagccugaagcaggacauuaucgcgguuaccgacugguccggcuacucugggagcuucauucagcaccccgagcucaccggacugaacuguaugagacccugcuucuggguggagcuuauccggggccgcccuaaggagaaaacaauuuggacguccgggagcucuaucuccuuuuguggcgucaauagcgauaccgugggauggucuuggccggacggcgccgaacugcccuucacaaucgauaaguga

SEQ ID NO: 209260 - RNA, 1353 nt, Artificial Sequence
  derived and/or modified sequence opt5 from neuraminidase_subtype_1__InfluenzaA__AAF74324
augaaccccaaucagaagaucauuaccaucggcagcauuugcaugguggucgggaucauuucccugaugcuccaaaucggaaacaucauuucuguuugggugagccacaucauucagacauggcauccuaaucagccggagcccuguaaccaguccaucaauuucuacacggaacaagccgcugccucugugacccuggcgggcaacagcucccuuugcccuauuucugggugggcuaucuauagcaaagacaauuccauuagaaucggaagcaagggcgaugucuuugugauccgggagcccuucauuucuuguucccaccuggaaugccgcacauuuuuccucacccagggggcccugcuuaacgacaaacauagcaauggaacaguuaaggauagaucuccuuaccggacccugauguccugucccgugggcgaggccccuagcccguauaacucucgcuuugaauccgucgcuuggagcgccuccgcuugccacgacggcaucucuuggcucacaauugggaucagcggacccgauaauggcgccguggcgguucugaaauacaacgggauuaucaccgacacgaucaaguccuggagaaauaacauucugcggacccaggagagcgagugugccugcgugaauggaucuuguuucacagucaugaccgauggcccuuccaacgaacaggcuagcuauaagaucuuuaaaauugagaaggggcgcguggugaaaucugucgaacucaacgcccccaauuaccauuaugaggagugcagcuguuacccugacgcuggagaaaucacaugcguuugcagagauaacuggcacggcuccaaucggcccugggugucuuucaaccaaaaucuggaguaccagauuggcuauaucuguagcgggguguuuggagacuccccgcgcccuaacgauggcaccgggagcugcggacccgucucucuuaauggcgccuacggggugaagggauucuccuuuaaauauggcaacggcguuuggaucgggagaacaaagagcacgucuucccggagcggauucgaaaugauuugggacccuaauggcuggaccgagacagauuccucuuuuagccugaagcaggacaucauugcgaucaccgacugguccggguacucuggcagcuucauucagcaccccgaacucaccggacugaacuguaugcgccccugcuucuggguggagcuuaucagagggcggccuaaagagaagacaauuuggacguccggcagcucugucuccuuuuguggagugaauagcgauaccaugggcuggucuuggccggacggggccgaacugcccuucacaaucgauaaauga

SEQ ID NO: 209261 - RNA, 1353 nt, Artificial Sequence
  derived and/or modified sequence opt5 from neuraminidase_subtype_1__InfluenzaA__AAF74325
augaaccccaaucagaagaucauuaccaucggcagcauuugcaugguggucgggaucauuucccugaugcuccaaaucggaaacacaaucucuguuugggugagccacauuaucaaaacguggcauccuaaucagccggagcccuguaaccaguccauuaauuucuacaccgaacaggccgcugccucugugacacuggcgggcaacagcucccuuugcccuaucucugggugggcuauuuauagcaaggacaauuccaucagaauuggaagcaaaggcgaugucuuugugauccgggagcccuucaucucuuguucccaccuggaaugccgcaccuuuuuccucacacaaggggcccugcuuaacgacaagcauagcaauggaaccguuaaagauagaucuccuuaccggacacugauguccugucccgugggcgaggccccuagcccguauaacucucgcuuugaauccgucgcuuggagcgccuccgcuugccacgacggcauuucuuggcucaccaucgggauuagcggacccgauaauggcgccguggcgguucugaaguacaacgggaucauuacggacaccaucaaguccuggagaaauaacacacugcggacccaggagagcgagugugccugcgugaauggaucuuguuucacagucaugaccgauggcccuuccaacgaacaggcuagcuauaaaaucuuuaagauugagaaagggcgcguggugaagucugucgaacucaacgcccccaauuaccauuaugaggagugcagcuguuacccugacgcuggagaaaucacgugcguuugcagagauaacuggcacggcuccaaucggcccugggugucuuucaaccagaaucuggaguaccaaauuggcuauaucuguagcgggguguuuggagacuccccgcgcccuaacgauggcacagggagcugcggacccgucucucuuaauggcgccuacggggugaaaggauucuccuuuaaguauggcaacggcguuuggauugggagaaccaagagcacaucuucccggagcggauucgaaaugaucugggacccuaauggcuggaccgagaccgauuccucuuuuagccugaaacaggacaucauugcgaucacagacugguccggguacucuggcagcuucauucagcaccccgaacucacgggacugaacuguaugcgccccugcuucuggguggagcuuaucagagggcggccuaaggagaaaaccauuuggacauccggcagcucuaucuccuuuuguggagucaauagcgauaccgugggcuggucuuggccggacggggccgaacugcccuauacaauugauaaguga

SEQ ID NO: 209262 - RNA, 1410 nt, Artificial Sequence; identical to SEQ ID NO: 199752
  derived and/or modified sequence opt5 from neuraminidase__InfluenzaA__EPI239900

SEQ ID NO: 209263 - RNA, 1410 nt, Artificial Sequence; identical to SEQ ID NO: 200101
  derived and/or modified sequence opt5 from neuraminidase__InfluenzaA__EPI221062

SEQ ID NO: 209264 - RNA, 1410 nt, Artificial Sequence; identical to SEQ ID NO: 199752
  derived and/or modified sequence opt5 from neuraminidase__InfluenzaA__EPI534079

SEQ ID NO: 209265 - RNA, 1410 nt, Artificial Sequence; identical to SEQ ID NO: 199752
  derived and/or modified sequence opt5 from neuraminidase__InfluenzaA__AGM53851

SEQ ID NO: 209266 - RNA, 1410 nt, Artificial Sequence
  derived and/or modified sequence opt5 from neuraminidase__InfluenzaA__EPI731464
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaggcucuagccugugcccuguuuccgggugggcuauuuacagcaaggacaauucugugagaaucggauccaaaggcgaugucuuugugauccgggagccguucauuagcuguucuccccucgaaugccgcaccuuuuuccugacacagggcgcccuucugaacgacaagcauuccaaugggaccaucaaagauagaagcccuuaucggacgcucaugucuugucccauuggagagguuccuucccccuacaacagccgcuuugaauccguggccuggucugcuagcgccugccacgacggcaucaacuggcugaccauugggaucuccggaccugauaauggcgcugucgccgugcugaaguauaacgggaucauuacagacaccaucaagagcuggagaaauaacauucuccggacacaagagucugagugugcgugcgugaauggauccuguuucaccgucaugacggauggcccgagcaacggccaggccucuuacaaaaucuuucgcauugaaaaggggaaaaucguuaagagcguggagaugaaugcucccaacuaucauuacgaagagugcuccuguuacccugacucuagcgagaucacaugcgugugcagagauaauuggcacggauccaaccggcccugggucagcuucaaucagaaccuggaauaucagauuggcuacaucuguucugggauuuuuggagacaauccucgccccaacgauaaaaccggcuccugcgggccggugagcucuaauggagccaacggcguuaagggcuucuccuuuaaguaugggaacggaguguggaucggcagaacaaaaagcauuuccucucggaauggguucgagaugaucugggacccuaacggauggaccggcaccgauaauaacuuuagcauuaagcaagacaucgucgggaucaaugaaugguccggcuacucuggcagcuucgugcagcaucccgagcuuacaggacuggacuguauucgcccuugcuucuggguugaacucaucagagggcggcccaaagagaacacgauuuggaccuccggaagcucuaucuccuuuuguggcgugaauagcgauacagucggguggucuuggcccgacggagcugagcugccuuucaccauugauaaguga

SEQ ID NO: 209267 - RNA, 1410 nt, Artificial Sequence; identical to SEQ ID NO: 199752
  derived and/or modified sequence opt5 from neuraminidase__InfluenzaA__EPI696973

SEQ ID NO: 209268 - RNA, 1410 nt, Artificial Sequence
  derived and/or modified sequence opt5 from neuraminidase__InfluenzaA__EPI662593
augaaccccaaucagaagaucauuaccaucggcagcauuugcaugacaaucgggauggccaaccugauucuccaaaucggaaauaucauuuccaucugggugucucacagcauucagaucggcaaccagucccagauugagacguguaaucaaucugucaucaccuacgaaaacaauacauggguuaaccagaccuaugugaauauuagcaacacaaauuucgcugccgggcaguccguggucucugugaaacuggcgggaaacagcucccuuugcccuguuagcggcugggcuaucuacucuaaggacaauuccgugagaaucgggagcaaaggagaugucuuugugauucgggagccguucaucucuuguagcccccuggaaugccgcaccuuuuuccucacacagggcgcccugcuuaacgacaagcauuccaauggcaccauuaaagauagaucuccuuaucggacgcugauguccugucccaucggggagguuccuagccccuacaacucccgcuuugaaucuguggccuggagcgcuuccgccugccacgacggaauuaacuggcucaccaucggcaucagcgggccugauucuggagcugucgccgugcugaaguauaauggcauuaucacagacaccauuaaguccuggagaaacaauauccugcggacacaagagagcgagugugcgugcgugaacgggucuuguuucaccauuaugacggauggaccgagcgacggccaggccuccuacaaaaucuuucgcaucgaaaagggcaaaauuaucaagucugucgagaugaaagcucccaauuaucauuacgaagagugcagcuguuacccugauuccagcgagauuacaugcguuugcagagacaacuggcacgggucuaaucggcccuggguguccuucaaccagaaucucgaauaucagaugggauacaucuguagcggcguguuuggggauaacccucgccccaaugacaagaccggaucuugcggcccggucuccagcaacggggccaauggagugaagggcuucuccuuuaaauauggcaacgggguuuggauuggaagaacaaagucuaucagcucccggaaaggcuucgagaugauuugggauccuaauggguggaccggaaccgacaacaaguuuucuaucaaacaagacaucgugggcauuaacgaauggagcggguacuccggcagcuucguccagcaucccgagcugacaggacuugauuguauccgcccuugcuucuggguggaacugauuagaggccggcccgaggagaauacgaucuggaccucuggguccagcauuucuuuuuguggaguuaacuccgacacagugggcuggagcuggcccgauggggcugaacucccuuucaccaucgacaaguga

SEQ ID NO: 209269 - RNA, 1410 nt, Artificial Sequence; identical to SEQ ID NO: 209268
  derived and/or modified sequence opt5 from neuraminidase__InfluenzaA__EPI830229

SEQ ID NO: 209270 - RNA, 1410 nt, Artificial Sequence; identical to SEQ ID NO: 206861
  derived and/or modified sequence opt5 from neuraminidase__InfluenzaA__AGU92879

SEQ ID NO: 209271 - RNA, 1410 nt, Artificial Sequence; identical to SEQ ID NO: 206860
  derived and/or modified sequence opt5 from neuraminidase__InfluenzaA__AGU92857

SEQ ID NO: 209272 - RNA, 1410 nt, Artificial Sequence; identical to SEQ ID NO: 206859
  derived and/or modified sequence opt5 from neuraminidase__InfluenzaA__AGU92846

SEQ ID NO: 209273 - RNA, 1410 nt, Artificial Sequence; identical to SEQ ID NO: 206870
  derived and/or modified sequence opt5 from neuraminidase__InfluenzaA__AGU92835

SEQ ID NO: 209274 - RNA, 1410 nt, Artificial Sequence; identical to SEQ ID NO: 206846
  derived and/or modified sequence opt5 from neuraminidase__InfluenzaA__AGU92703

SEQ ID NO: 209275 - RNA, 1410 nt, Artificial Sequence
  derived and/or modified sequence opt5 from neuraminidase__InfluenzaA__EPI643117
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaauguauuugcaucaacggaacauguacgguggugaugaccgacggcuccgcuagcgggaaggccgauacaaaaauccuguuuauugaggagggaaagaucguccauaccuccacacucucuggcagcgcgcaacacguugaagagugcuccugcuaucccagauacccuggggugcggugugugugccgcgacaacuggaagggaagcaauagacccauugucgauaucaacauuaaagaccacucuaucguguccagcuacguuuguucuggccuggugggcgacaccccgcggaagaaugauagcuccucuagcucccauugccuugacccuaacaaugaagaagggggacacggcgucaaagggugggccuucgaugacggaaacgauguguggaugggccgcacgaucaaugagacaagcagacugggguaugagaccuuuaagguuauugagggauggucuaaccccaaauccaagcuccagaccaaucgccaggugaucgucgaccggggcgauagaagcggcuacucugggauuuucuccguggaaggaaaaagcuguaucaaccggugcuuuuaugucgagcugauuagaggccgcaaggaagagacagaagugcuguggaccuccaauucuaucguuguguucugugggacaagcggaacguacggcaccggguccuggccugacggcgcugaucucaaccugaugcccauuuga

SEQ ID NO: 209276 - RNA, 1410 nt, Artificial Sequence
  derived and/or modified sequence opt5 from neuraminidase__InfluenzaA__EPI675797
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaagguucgggaccgcacccccuauagaacgcugcucaugaaugaacugggggugccuuuucaccugggaacaaaacaggucugcauugccugguccucuagcuccugucaugauggcaaggccuggcuccacgugugcaucaccggcgacgauaaaaacgcuacagccagcuucauuuacaaugggcggcugguugacucuguggucuccuggagcaaggauauccuucgcacccaggagucugaauguauuugcaucaacggaaccuguacaguggugaugacggacggcuccgcuagcgggaaagccgauaccaagauccuguuuauugaggagggaaagaucguccauacauccacccucucuggcagcgcgcaacacguugaagagugcuccugcuaucccagauacccuggggugcggugugugugccgcgacaacuggaaaggaagcaauagacccauugucgauaucaacauuaaggaccacucuaucguguccagcuacguuuguucuggccuggugggcgacacaccgcggaaaaaugauagcuccucuagcucccauugccuugacccuaacaaugaagaagggggacacggcgucaaggggugggccuucgaugacggaaacgauguguggaugggccgcaccaucaaugagacgagcagacugggguaugagacauuuaaaguuauugagggauggucuaaccccaaguccaaacuccagaccaaucgccaggugaucgucgaccggggcgauagaagcggcuacucugggauuuucuccguggaaggaaagagcuguaucaaccggugcuuuuaugucgagcugauuagaggccgcaaggaagagaccgaagugcuguggacauccaauucuaucguuguguucugugggaccagcggaacauacggcacgggguccuggccugacggcgcugaucucaaccugaugcccauuuga

SEQ ID NO: 209277 - RNA, 1410 nt, Artificial Sequence; identical to SEQ ID NO: 209275
  derived and/or modified sequence opt5 from neuraminidase__InfluenzaA__EPI578429

SEQ ID NO: 209278 - RNA, 1410 nt, Artificial Sequence; identical to SEQ ID NO: 209275
  derived and/or modified sequence opt5 from neuraminidase__InfluenzaA__EPI614405

SEQ ID NO: 209279 - RNA, 1350 nt, Artificial Sequence; identical to SEQ ID NO: 209197
  derived and/or modified sequence opt5 from neuraminidase__InfluenzaA__AAT73329

SEQ ID NO: 209280 - RNA, 1350 nt, Artificial Sequence; identical to SEQ ID NO: 209197
  derived and/or modified sequence opt5 from neuraminidase__InfluenzaA__AAW80723

SEQ ID NO: 209281 - RNA, 1350 nt, Artificial Sequence; identical to SEQ ID NO: 209197
  derived and/or modified sequence opt5 from neuraminidase__InfluenzaA__EF541467

SEQ ID NO: 209282 - RNA, 1398 nt, Artificial Sequence; identical to SEQ ID NO: 206478
  derived and/or modified sequence opt5 from neuraminidase__InfluenzaA__EPI439509

SEQ ID NO: 209283 - RNA, 1410 nt, Artificial Sequence
  derived and/or modified sequence opt5 from neuraminidase__InfluenzaA__EPI482776
augaacaccaaucagagaaucauuacaaucggcacggugugcaugauugucgggaucauuagccugcuccugcaaaucggaaacaucguuucccuuuggauuucucacagcauccagaccggcugggagaaucauacagugauguguaaccaguccgugauuaccuacgucaauaacacaugggugaaucggaccuauguuaacaucucuaauauuaagaucgccacaauucaggacgugaccagcaucauccuggcugggaacuccucucucugccccgucagcggaugggccguguacuccaaagauaauagcauucgcaucggcucuaagggggacauuuucguuaucagagaaccuuuuauuuccuguagccaacuggagugccggacguucuuucuuacccagggagcgcugcucaacgauaaacacucuaauggcacagugaaggaccgcuccccguauagaacccugaugagcugucccaucggcgaagcuccuucucccuacaacucccgguucgagagcgucgccugguccgccucugcuugccaugaugggaugggauggcugacaaucggcauuagcgggccugacaauggagccguggcugugcucaaauauaacggcaucauuaccgauacgaucaaguccuggcgcaacaagauucugagaacacaggaaagcgagugugucugcaugaaugggucuuguuuuaccguucuuacagacggacccuccaacggccaggccagcuacaaaaucuucaagguggagaaaggcaagaucauuaaaucuaucgaacuggaugcgccuaauuaucacuacgaggaaugcagcuguuacccggacaccgggaaggugaugugcgucugccgggauaacuggcaugccuccaaucgccccugggugucuuuuaaccaaaaucucgacuaucagauuggauacaucuguagcggcguuuucggggauaacccuagauccaaugacggaaagggcaacugcgggcccgugcugagcaauggagcuaacggcgucaaaggcuuuucuuaucgguacgggaauggaguguggauuggccgcaccaaguccaucaacagcagaucuggguucgagaugauuugggacccuaauggauggacagagacggauuccagcuuuuccaugaaacaggacaucaucgcccuuaacgauuggucuggcuauagcggguccuucguucagcaccccgaacugaccggcaugaacuguauucggccgugcuuuuggguggagcucauccgcggacaaccuaaggaaucuacaauuugggcuagcggcuccagcaucucuuucuguggggucaauuccgagaccgccagcuggucuuggcccgacggagcggaucugccuuucacaauugacaaauga

SEQ ID NO: 209284 - RNA, 1410 nt, Artificial Sequence
  derived and/or modified sequence opt5 from neuraminidase__InfluenzaA__EPI745533
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaugaucugggauccuaauggguggaccggaaccgacaacaauuuuuccaucaagcaagacauugugggcaucaacgaauggucuggguacagcggcuccuucguccagcaucccgagcuuacaggacuggauuguauuaaaccuugcuucuggguggaacucauccgcggcagacccaaggagaauacgauuuggaccagcgggucuuccaucagcuuuuguggaguuaacucugacacagugggcugguccuggcccgauggggcugagcugccuuucaccaucgacaaauga

SEQ ID NO: 209285 - RNA, 1410 nt, Artificial Sequence; identical to SEQ ID NO: 199752
  derived and/or modified sequence opt5 from neuraminidase__InfluenzaA__AEE69012

SEQ ID NO: 209286 - RNA, 1410 nt, Artificial Sequence; identical to SEQ ID NO: 199752
  derived and/or modified sequence opt5 from neuraminidase__InfluenzaA__EPI176609

SEQ ID NO: 209287 - RNA, 1410 nt, Artificial Sequence; identical to SEQ ID NO: 199752
  derived and/or modified sequence opt5 from neuraminidase__InfluenzaA__EPI176472

SEQ ID NO: 209288 - RNA, 1410 nt, Artificial Sequence
  derived and/or modified sequence opt5 from neuraminidase__InfluenzaA__EPI280340
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaucaucugggauccuaauggguggaccggaaccgacaacaauuuuuccauuaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccaucagcuuuuguggaguuaacucugacacagugggcugguccuggcccgauggggcugagcugccuuucaccauugacaaguga

SEQ ID NO: 209289 - RNA, 1410 nt, Artificial Sequence; identical to SEQ ID NO: 199752
  derived and/or modified sequence opt5 from neuraminidase__InfluenzaA__EPI240318

SEQ ID NO: 209290 - RNA, 1410 nt, Artificial Sequence; identical to SEQ ID NO: 199752
  derived and/or modified sequence opt5 from neuraminidase__InfluenzaA__EPI183133

SEQ ID NO: 209291 - RNA, 1410 nt, Artificial Sequence; identical to SEQ ID NO: 199752
  derived and/or modified sequence opt5 from neuraminidase__InfluenzaA__EPI369141

SEQ ID NO: 209292 - RNA, 1410 nt, Artificial Sequence
  derived and/or modified sequence opt5 from neuraminidase__InfluenzaA__EPI482787
augaacaccaaucagagaaucauuacaaucggcacggugugccugauugucgggaucguuagccuccugcuucaaauuggaaacaucgugucccuguggaucucucacagcauucagaccggcaagcggucccaucccgagacauguucucagaaugugaucaccuacgaaaacaauacaugggucaaccagaccuaugugaauauuagcaacacaaauaucguugacgggcaaggagugaccuccauuauccucgccggcaacucuccucugugcccgauuagcgggugggcuaucuacuccaaagauaauagcauccgcauuggaucuaagggcgacaucuucgucauuagagagcccuuuaucuccuguagccaccuugaaugccggacguucuuucugacccagggcgcccuccugaacgaucgccauucuaaugggacagugaaagacagauccccuuaucggacccugaugagcugucccauuggagaggcgccuucucccuacaacucccgcuucgaaagcguugcuugguccgccucugccugccacgauggcaugggguggcucacaaucggaaucagcggcccugacaauggggcuguggccguccugaaguauaacggaauuaucaccgauacgauuaaauccuggagaaacaagauccuucggacacaggagagcgagugugugugcauuaauggcucuuguuuuaccaucaugacagacggcccguccaacgggcaggcuagcuacaagaucuucaaaauggaaaagggaaaaauuaucaagucuguggagcuggaugcccccaauuaucauuacgaagagugcagcuguuacccugacaccggcaaagucguuugcgugugccgcgauaacuggcacgcguccaauagacccugggugaccuuugaccaaaaccucaauuaucagauuggguacaucuguucuggagucuucggcgauaacccucggagcaaugacgggaagggaaacugcggccccgugccguccaauggcgccaacgggguuaagggauuuagcuuccgcuauggcaaugggguguggauuggaagaacaaaaucuaucuccagccggucuggcuuugagaugauuugggacccuaacggguggacggaaaccgauuccagcuucuccaucaagcaggacaucauugcucugacagauuggucuggcuacagcggauccuuuguccagcaccccgagcuuaccggcaugaauuguaucaaaccuugcuucuggguggaacugauucgcgggcaacccaaggagucuacaaucuggaccagcggauccagcauuucuuucuguggcguugacuccgaaacggugagcuggucuuggcccgauggggccgaccucccuuuuacaaucgauaaauga

SEQ ID NO: 209293 - RNA, 1410 nt, Artificial Sequence
  derived and/or modified sequence opt5 from neuraminidase__InfluenzaA__EPI482790
augaacaccaaucagagaaucauuacaaucggcacggugugccugauugucgggaucauuagccuccugcuucaaaucggaaacaugguuucccuguggaucucucacagcauucagaccggcgggaagaaucauacagagauguguaaccagaaugugaucaccuacgugaacaauacaugggucaaccggaccuaugugaauauuuccaacacaaaaaucguuaaugugcaggacgucgugucuguuauucucaccggaaacagcucccugugccccaucucuggcugggccauuuacagcaaggauaauuccauccgcaucgggagcaaaggagacauuuucgugaucagagaaccuuuuauuucuuguucccaccuugagugccggacguucuuucugacccaaggcgcucuccugaacgauaagcauagcaauggcacagucaaagaccgcucuccguauagaacccugauguccugucccgugggggaagccccuagccccuacaacucucgguucgaguccguggcguggagcgcuuccgccugccacgauggaaugggcuggcucacaaucgggauuucuggaccugacaacggcgccgucgcuguucugaaguauaaugggaucaucaccgauacgauuaagagcuggcgcaacaaaauccuuagaacacaggaauccgagugugugugcaugaauggaagcuguuuuaccgugcugacagacggccccucuaacggccaggccuccuacaagauuuucaaaauggagaaggggaaaaucauuaagagcaucgaacucgaugcuccuaauuaucauuacgaggaaugcucuuguuacccggacgccggaaaggucaugugcgugugccgggauaacuggcacgcgagcaaucgccccuggguuuccuuugaccagaaccuggauuaucaaaucggcuacauuuguucugggguguucggagacaauccuagaagcaacgacggcaaagggaauugcggacccguccacuccaacggcgccaauggcgugaagggguuuagcuaucgguacggaaacggcguuuggaucgggcgcaccaaaucuauuaauuccagaagcggauucgagaugaucugggauccuaacggcuggaccgggacagacucuuccuuuagcaugaagcaggauauuaucgcucuuacggacugguccggcuauucuggcagcuucgugcagcaucccgagcugaccggaaugaacuguauucggccgugcuuuugggucgaacucauccgcgggcagccuaaagagaauacaaucugggccuccggaucuagcauuuccuucuguggcgugaacggggaaaccgcuagcuggucuuggcccgauggagccgaccugccuuucacaaucgauaaguga

SEQ ID NO: 209294 - RNA, 1410 nt, Artificial Sequence
  derived and/or modified sequence opt5 from neuraminidase__InfluenzaA__EPI291797
augaacaccaaucagagaaucauuacaaucggcacggugugcaugauugucgggaucauuagccugcuccugcaaaucggaaacaucguuucccuuuggauuucucacagcauccagaccggcugggagaaucauacagaaauguguaaccaguccgugauuaccuacgugaauaacacaugggucaaucggaccuaugugaacaucucuaauacaaacauugccaccauccaggacguuacgagcauuauccuggcuggaaauuccucucucugccccgugagcgggugggccaucuacuccaaggauaacagcauucgcaucggcucuaaaggggacauuuucgucaucagagagccuuuuauuuccuguagccaacuggaaugccggaccuucuuucuuacacagggagcgcugcucaaugauaagcacucuaacggcaccgugaaagaccgcuccccguauagaacacugaugagcugucccaucggcgaggcuccuucucccuacaauucccgguucgaaagcguugccugguccgccucugcuugccaugaugggaugggauggcugaccaucggcauuagcgggccugacaacggagccguggcuguccucaaguauaacggcaucauuacggauacaaucaaauccuggcgcaauaagauucugagaacccaggagagcgagugugugugcaugaacgggucuuguuuuacagugcuuaccgacggacccuccaauggccaggccagcuacaagaucuucaaagucgaaaagggcaaaaucauuaagucuaucgagcuggaugcgccuaacuaucacuacgaagagugcagcuguuacccggacaccgggaaaguuaugugcgugugccgggauaauuggcaugccuccaaccgccccugggugucuuuuaaucaaaaccucgacuaucagauuggauacaucuguagcggcgucuucggggauaauccuagauccaacgacggaaagggcaauugcgggcccgugcugagcaacggagcuaauggcguuaagggcuuuucuuaucgguacgggaacggaguguggauuggccgcacaaaauccaucaauagcagaucuggguucgagaugauuugggacccuaacggauggacggaaaccgauuccagcuuuuccaugaagcaggacaucaucgcccuuacagauuggucuggcuauagcggguccuucguccagcaccccgagcugaccggcaugaacuguauucggccgugcuuuuggguggaacucauccgcggacaaccuaaagagucuacaauuugggcuagcggcuccagcaucucuuucugugggguuaauuccgaaaccgccagcuggucuuggcccgacggagcggaucugccuuucacgauugacaaguga

SEQ ID NO: 209295 - RNA, 1410 nt, Artificial Sequence; identical to SEQ ID NO: 209294
  derived and/or modified sequence opt5 from neuraminidase__InfluenzaA__EPI482798

SEQ ID NO: 209296 - RNA, 1410 nt, Artificial Sequence
  derived and/or modified sequence opt5 from neuraminidase__InfluenzaA__EPI638969
augaacaccaaucagagaaucauuacaaucggcacggugugcaugauugucgggaugaucagccugcuccugcaaauuggauccaucguuucucuuuggaucagccacuccauucagaccggcugggagaaccauacagggguguguaaucagucugugaucaccuacgucaacaauacaugggugaaccggaccuauguuaauauuagcaacaucaagauugccacaauccaggacgugacccccauuauccuggcuggaaauuccucucucugcccugucaacggcugggccguguacagcaaagauaauuccauccgcauugggagcaagggagacaucuucguuauuagagaaccguuuaucucuuguucccaacuggagugccggacguucuuucuuacccagggcgcgcugcucaacgauaaacacagcaauggcacagugaaggaccgcucucccuauagaacccugauguccuguccuauuggggaagcucccagcccuuacaacucucgguucgaguccgucgccuggagcgccuccgcuugccaugauggaaugggcuggcugacaaucgggaucucuggacccgacaauggcgccguggcugugcucaaauauaacgggauuaucaccgauacgauuaagagcuggcgcaacaagauccugagaacacaggaauccgagugugucugcaugaauggaagcuguuuuaccguucuuacagacggcccuucuaacggccaggccuccuacaaaauuuucaagguggagaaagggaagaucaucaaaagcauugaacuggaugcgccgaauuaucacuacgaggaaugcucuuguuaccccgacaccggaaaggugaugugcgucugccgggauaacuggcaugccagcaaucgcccuuggguguccuuuaaccaaaaucucgacuaucagaucggcuacauuuguucugggguuuucggagauaaccccagaagcaccgacggcaaggggaauugcggaccugugcuguccaacggcgcuaauggcgucaaaggguuuagcuaucgguacggaaacggcguguggaucgggcgcacaaagucuauuaauuccagaagcggauucgagaugaucugggaccccaacggcuggacggagaccgauucuuccuuuagcaugaaacaggacauuaucgcccuuaaugauuauuccggguacucuggcagcuucguucagcacccggaacugacaggaaugaacuguauccggccuugcuuuuggguggagcucauucgcggccaacccaaggaauccaccaucugggcuucugggagcuccauuagcuucuguggagucaacucugagacagccuccuggagcuggccugacggcgcggaucugcccuucgccaucgacaaauga

SEQ ID NO: 209297 - RNA, 1410 nt, Artificial Sequence
  derived and/or modified sequence opt5 from neuraminidase__InfluenzaA__ABI19012
augaacaccaaucagagaaucauuacaaucggcacggugugccugauugucgggaucauuagccuccugcuucaaaucggaaacaugguuucccuguggaucucucacagcauucagaccggcgggaagaaucauacagagauguguaaccagaaugugaucaccuacgugaacaauacaugggucaaccggaccuaugugaauauuuccaacacaaaaaucguuaaugugcaggacgucgugucuguuauucucaccggaaacagcucccugugccccaucucuggcugggccauuuacagcaaggauaauuccauccgcaucgggagcaaaggagacauuuucgugaucagagaaccuuuuauuucuuguucccaccuugagugccggacguucuuucugacccaaggcgcucuccugaacgauaagcauagcaauggcacagucaaagaccgcucuccguauagaacccugauguccugucccaucggggaagccccuagccccuacaacucucgguucgaguccguggcguggagcgcuuccgccugccacgauggaaugggcuggcucacaauugggaucucuggaccugacaacggcgccguggcuguccugaaguauaaugggaucauuaccgauacgaucaagagcuggcgcaacaaaauucuuagaacacaggaauccgaguguguuugcaugaauggaagcuguuuuaccgugcugacagacggccccucuaacggccaggccuccuacaagaucuucaaaauggagaaggggaaaauuaucaagagcaucgaacucgaugcuccuaauuaucauuacgaggaaugcucuuguuacccggacgccggaaaggugaugugcgucugccgggauaacuggcacgcgagcaaucgccccuggguguccuuugaccagaaccuggauuaucaaauuggcuacaucuguucugggguuuucggagacaauccuagaagcaacgacggcaaagggaauugcggacccgugcacuccaacggcgccaauggcgucaagggguuuagcuaucgguacggaaacggcguguggauugggcgcaccaaaucuaucaauuccagaagcggauucgagaugauuugggauccuaacggcuggaccgggacagacucuuccuuuagcaugaagcaggauaucauugcucuuacggacugguccggcuauucuggcagcuucguucggcaucccgagcugaccggaaugaacuguauccgcccgugcuuuuggguggaacucaucagagggcagccuaaagagaauacaauuugggccuccggaucuagcaucuccuucuguggcgucaacggggaaaccgcuagcuggucuuggcccgauggagccgaccugccuuucacaauugauaaguga

SEQ ID NO: 209298 - RNA, 1410 nt, Artificial Sequence
  derived and/or modified sequence opt5 from neuraminidase__InfluenzaA__EPI687791
augaaccccaaucagaagaucauuaccaucggcagcauuugcaugacaaucgggauggccaaccugauucuccaaaucggaaauaucauuuccaucugggugucucacagcauucagaucggcaaccagucccagauugagacguguaaucaaucugucaucaccuacgaaaacaauacauggguuaaccagaccuaugugaauauuagcaacacaaauuucgcugccagacaguccguggucucugugaaacuggcggggaacagcucccuuugcccuguuagcggaugggcuaucuacucuaaggacaauuccgugcggaucggcagcaaaggggaugucuuugugauucgcgagccguucaucucuuguagcccccuggaaugcagaaccuuuuuccucacacagggagcccugcuuaacgacaagcauuccaauggcaccauuaaagaucggucuccuuaucgcacgcugauguccugucccaucggcgagguuccuagccccuacaacuccagauuugaaucuguggccuggagcgcuuccgccugccacgacgggauuaacuggcucaccaucggaaucagcggcccugauucuggggcugucgccgugcugaaguauaauggaauuaucacagacaccauuaaguccuggcggaacaauauccugcgcacacaagagagcgagugugcgugcgugaacggcucuuguuucaccauuaugacggaugggccgagcgacggacaggccuccuacaaaaucuuuagaaucgaaaagggcaaaauuaucaagucugucgagaugaaagcucccaauuaucauuacgaagagugcagcuguuacccugauuccagcgagauuacaugcguuugccgggacaacuggcacggcucuaaucgccccuggguguccuucaaccagaaucucgaauaucagaugggguacaucuguagcggaguguuuggcgauaacccuagacccaaugacaagaccgggucuugcggaccggucuccagcaacggcgccaauggggugaagggauucuccuuuaaauauggcaacggcguuuggauugggcggacaaagucuaucagcucccgcaaaggauucgagaugauuugggauccuaauggcuggaccgggaccgacaacaaguuuucuaucaaacaagacaucgugggaauuaacgaauggagcggcuacuccgggagcuucguccagcaucccgagcugacaggccuugauuguaucagaccuugcuucuggguggaacugauucggggacgccccgaggagaauacgaucuggaccucuggcuccagcauuucuuuuugugggguuaacuccgacacagugggauggagcuggcccgauggcgcugaacucccuuucaccaucgacaaguga

SEQ ID NO: 209299 - RNA, 1410 nt, Artificial Sequence
  derived and/or modified sequence opt5 from neuraminidase__InfluenzaA__EPI841266
augaaccccaaucagaagaucauuaccaucggcagcauuugcaugacaaucgggauggccaaccugauucuccaaaucggaaauaucauuuccaucugggugucucacagcauucagaucggcaaccagucccagauugagacguguaaucaaucugucaucaccuacgaaaacaauacauggguuaaccagaccuaugugaauauuagcaacacaaauuucgcugccagacaguccguggucucugugaaacuggcggggaacagcucccuuugcccuguuagcggaugggcuaucuacucuaaggacaauuccgugcggaucggcagcaaaggggaugucuuugugauucgcgagccguucaucucuuguagcccccuggaaugcagaaccuuuuuccucacacagggagcccugcuuaacgacaagcauuccaauggcaccauuaaagaucggucuccuuaucgcacgcugauguccugucccaucggcgagguuccuagccccuacaacuccagauuugaaucuguggccuggagcgcuuccgccugccacgacgggauuaacuggcucaccaucggaaucagcggcccugauucuggggcugucgccgugcugaaguauaauggaauuaucacagacaccauuaaguccuggcggaacaauauccugcgcacacaagagagcgagugugcgugcgugaacggcucuuguuucaccauuaugacggaugggccgagcgacggacaggccuccuacaaaaucuuuagaaucgaagagggcaagauuaucaaaucugucgaaaugaaggcucccaauuaucauuacgaggagugcagcuguuacccugauuccagcgaaauuacaugcguuugccgggacaacuggcacggcucuaaucgccccuggguguccuucaaccagaaucucgaguaucagaugggguacaucuguagcggaguguuuggcgauaacccuagacccaaugacaaaaccgggucuugcggaccggucuccagcaacggcgccaauggggugaagggauucuccuuuaaguauggcaacggcguuuggauugggcggacaaaaucuaucagcucccgcaagggauucgaaaugauuugggauccuaauggcuggaccgggaccgacaacaaauuuucuaucaagcaagacaucgugggaauuaacgaguggagcggcuacuccgggagcuucguccagcaucccgaacugacaggccuugauuguaucagaccuugcuucuggguggagcugauucggggacgccccgaggaaaauacgaucuggaccucuggcuccagcauuucuuuuugugggguuaacuccgacacagugggauggagcuggcccgauggcgcugagcucccuuucaccaucgacaaauga

SEQ ID NO: 209300 - RNA, 1410 nt, Artificial Sequence
  derived and/or modified sequence opt5 from neuraminidase__InfluenzaA__EPI291844
augaacaccaaucagagaaucauuacaaucggcacggugugccugauugucgggaucauuagccuccugcuucaaaucggaaccaugguuucccuguggaucucucacagcauucagacaggcgggaagaaccauaccgagauguguaaucagaacgugaucacauacgugaauaacaccugggucaaucggacauaugugaacauuuccaauaccaaaaucguuaacgugcaggacgucgugucuguuauucucacgggaaauagcucccugugccccaucucuggcugggccauuuacagcaaggauaacuccauccgcaucgggagcaaaggagacauuuucgugaucagagaaccuuuuauuucuuguucccaccuugagugccggaccuucuuucugacacaaggcgcucuccugaaugauaagcauagcaacggcaccgucaaagaccgcucuccguauagaacacugauguccugucccaucggggaagccccuagccccuacaauucucgguucgaguccguggcguggagcgcuuccgccugccacgauggaaugggcuggcucaccauugggaucucuggaccugacaacggcgccguggcuguccugaaguauaacgggaucauuacggauacaaucaagagcuggcgcaauaaaauucuuagaacccaggaauccgaguguguuugcaugaacggaagcuguuuuacagugcugaccgacggccccucuaauggccaggccuccuacaagaucuucaaaauggagaaggggaaaauuaucaagagcaucgaacucgaugcuccuaacuaucauuacgaggaaugcucuuguuacccggacgccggaaaggugaugugcgucugccgggauaauuggcacgcgagcaaccgccccuggguguccuuugaccagaaucuggauuaucaaauuggcuacaucuguucugggguuuucggagacaacccuagaagcaaugacggcaaagggaacugcggacccgugcacuccaauggcgccaacggcgucaagggguuuagcuauaaauacggaaauggcguguggauugggcggaccaagucuaucaacucccgcagcggauucgagaugauuugggauccuaauggcuggacagggacggacucuuccuuuagcaugaaacaggauaucauugcucuuaccgacugguccggcuauucuggcagcuucguucagcaucccgagcugacaggaaugaacuguaucagaccgugcuuuuggguggaacucauccgggggcagccuaaggagaacaccauuugggccuccggaucuagcaucuccuucuguggcgucaauggggaaacagcuagcuggucuuggcccgauggagccgaccugccuuucaccauugauaaauga

SEQ ID NO: 209301 - RNA, 1410 nt, Artificial Sequence
  derived and/or modified sequence opt5 from neuraminidase__InfluenzaA__EPI558120
augaacaccaaucagagaaucauuacaaucggcacggugugcaugauugucgggaucauuagccugcuccugcaaaucggaaacaucguuucccuuuggauuucucacagcauccagaccggcugggagaaucauacagaaauguguaaccaguccgugauuaccuacgugaauaacacauggaugaaucggaccuaugucaacaucucuaauauuaagaucgccacaauucaggacgugaccagcaucguucuggcugggaacuccucucucugccccgugagcggaugggccgucuacuccaaagauaauagcauccgcauuggcucuaagggggacaucuucgugauuagagagccuuuuaucuccuguagccaacuggaaugccggacguucuuucuuacccagggagcgcugcucaacgauaaacacucuaauggcacaguuaaggaccgcuccccguauagaacccugaugagcugucccauuggcgaggcuccuucucccuacaacucccgguucgaaagcguggccugguccgccucugcuugccaugaugggaugggauggcugacaaucggcaucagcgggccugacaauggagccgucgcugugcucaaauauaacggcauuaucaccgauacgauuaaguccuggcgcaacaagauccugagaacacaggagagcgagugugugugcauuaaugggucuuguuuuaccguccuuacagacggacccuccaacggccaggccagcuacaaaaucuucaagguugaaaaaggcaagaucauuaaaucuaucgagcuggaugcgccuaauuaucacuacgaagagugcagcuguuacccggacaccgggaaggugaugugcauuugccgggauaacuggcaugccuccaaucgccccugggugucuuuugaccaaaaccucgauuaucagaucggauacauuuguagcggcgucuucggggacaauccuagauccaacgacggaaagggcaauugcgggcccgugcugagcaacggagcuaauggcguuaaaggcuuuucuuaucgguacgggaacggaguguggaucggccgcaccaaguccauuaauagcagaucuggguucgagaugaucugggauccuaacggauggacagaaacggacuccagcuuuuccaugaaacaggauaucauugcccuuaaugacuggucuggcuauagcggguccuucguccagcaccccgagcugaccggcaugaacuguauccggccgugcuuuuggguggaacucauucgcggacaaccuaaggagucuacaaucugggcuagcggcuccagcauuucuuucugugggguuaacuccgaaaccgccagcuggucuuggcccgauggagcggaccugccuuucacaaucgauaaauga

SEQ ID NO: 209302 - RNA, 1410 nt, Artificial Sequence
  derived and/or modified sequence opt5 from neuraminidase__InfluenzaA__EPI564138
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccaagcucucuggcagcgcgcaacacguggaagagugcuccugcuaucccagauacccuggggugcggugugucugccgcgacaacuggaaaggaagcaauagacccaucguggauauuaacaucaaggaccacucuauuguuuccagcuacguguguucuggccuggucggcgacacaccgcggaaaaaugauagcuccucuagcucccauugccuugacccuaacaaugaagaagggggacacggcgugaaggggugggccuucgaugacggaaacgauguuuggaugggccgcaccaucaaugagacgagcagacugggguaugagacauuuaaaguggucgagggauggucuaaccccaaguccaaacuccagaucaaucgccaggugauugucgaccggggcgauagaagcggcuacucugggaucuucuccguggaaggaaagagcuguauuaaccggugcuuuuauguugagcugaucagaggccgcaaggaagagaccgaagugcuguggaccuccaauucuauugucguguucugugggacaagcggaaccuacggcacaggguccuggccugacggcgcugaucucaaccugaugcccaucuga

SEQ ID NO: 209303 - RNA, 1410 nt, Artificial Sequence
  derived and/or modified sequence opt5 from neuraminidase__InfluenzaA__ANM92825
augaaccccaaucagaagaucauuaccaucggcagcauuugcaugacaaucgggauggccaaccugauucuccaaaucggaaauaucauuuccaucugggugucucacagcauucagaucggcaaccagucccagauugagacguguaaucaaucugucaucaccuacgaaaacaauacauggguuaaccagaccuaugugaauauuagcaacacaaauuucgcugccgggcaguccguggucucugugaaacuggcgggaaacagcucccuuugcccuguuagcggcugggcuaucuacucuaaggacaauuccgugagaaucgggagcaaaggagaugucuuugugauucgggagccguucaucucuuguagcccccuggaaugccgcaccuuuuuccucacacagggcgcccugcuuaacgacaagcauuccaauggcaccauuaaagauagaucuccuuaucggacgcugauguccugucccaucggggagguuccuagccccuacaacucccgcuuugaaucuguggccuggagcgcuuccgccugccacgacggaauuaacuggcucaccaucggcaucagcgggccugauucuggagcugucgccgugcugaaguauaauggcauuaucacagacaccauuaaguccuggagaaacaauauccugcggacacaagagagcgagugugcgugcgugaacgggucuuguuucaccauuaugacggauggaccgagcgacggccaggccuccuacaaaaucuuucgcaucgaaaagggcaaaauuaucaagucugucgagaugaaagcucccaauuaucauuacgaagagugcagcuguuacccugauuccagcgagauuacaugcguuugcagagacaacuggcacgggucuaaucggcccuggguguccuucaaccagaaucucgaauaucagaugggauacaucuguagcggcguguuuggggauaacccucgccccaaugacaagaccggaaacugcggcccggucucuuccaauggggccaacggagugaagggcuucagcuuuaaauauggcaaugggguuuggauuggaagaacaaaguccaucucuagccggaaaggcuucgagaugauuugggauccuaacggguggaccggaaccgacaacaaguuuuccaucaaacaagacaucgugggcauuaaugaauggucuggguacagcggcuccuucguccagcaucccgagcugacaggacuugauuguauccgcccuugcuucuggguggaacugauuagaggccggcccgaggagaacacgaucuggaccagcgggucuuccauuagcuuuuguggaguuaauucugacacagugggcugguccuggcccgauggggcugaacucccuuucaccaucgacaaguga

SEQ ID NO: 209304 - RNA, 1410 nt, Artificial Sequence
  derived and/or modified sequence opt5 from neuraminidase__InfluenzaA__EPI291694
augaacaccaaucagagaaucauuacaaucggcacggugugccugauugucgggaucguuagccuccugcuucaaauuggaaacaucgugucccuguggaucucucacagcauucagaccggcgagaagaaucauuccgaaguguguaaccagaauaucauuacauacgagaacaaaaccugggucaaucagacauaugugaacaucucuaauaccaacauugccgaagggcaaggaguuacaagcaucauucucgcuggcaauuccucucugugccccgugagcgggugggccaucuacuccaaggacaacagcauccggauuggaucuaaaggcgauaucuucgucauucgcgagccuuuuaucuccuguagccaccuugaaugcagaaccuucuuucugacgcagggcgcgcuccugaaugaccggcauucuaacgggaccgugaaggaucgcuccccguauagaacacugaugagcugucucaccggagaggcucccucuccuuacaauucccgguucgagagcguugccugguccgccucugcuugccacgacggcaugggguggcugacaauuggaaucagcggccccgauaacggggccguggcuguccuuaaauauaacggaaucauuaccgacacgaucaaguccuggcgcaauaagauucugagaacacaggaaagcgagugugugugcaucaacggcucuuguuuuaccauuaugacagauggcccuuccaaugggcaggccagcuacaaaaucuucaagauggaaaaaggaaagaucauuaaaucuguggagcucgacgcgcccaacuaucauuacgaggaaugcagcuguuacccugauaccggcaaggucguuugcgugugccgggacaauuggcacgccuccaaccgcccgugggugucuuuugaucaaaaucuggacuaucagaucggguacauuuguagcggagucuucggcgauaaccccagauccaaugacgggaagggaaacugcggcccugugcccagcaauggcgcuaacgggguuaaaggauuuucuuuccgguauggcaaugggguguggaucggacgcaccaaguccauuaucagcagaucuggcuuugagaugauuugggacccuaacggguggacagaaacggauuccagcuucuccaucaaacaggacaucauugcccuuaccgauuggucuggcuacagcggauccuuuguccagcaccccgagcugacaggcaugaauuguauccggccgugcuucuggguggaacucauucgcgggcaaccuaaggagucuaccaucuggacaagcggauccagcauuucuuucuguggcguugacuccgagaccgcuagcuggucuuggcccgauggggccgaccugccuuuuacgaucgauaaauga

SEQ ID NO: 209305 - RNA, 1410 nt, Artificial Sequence; identical to SEQ ID NO: 200238
  derived and/or modified sequence opt5 from neuraminidase__InfluenzaA__EPI241027

SEQ ID NO: 209306 - RNA, 1410 nt, Artificial Sequence; identical to SEQ ID NO: 199762
  derived and/or modified sequence opt5 from neuraminidase__InfluenzaA__EPI177405

SEQ ID NO: 209307 - RNA, 1410 nt, Artificial Sequence; identical to SEQ ID NO: 199762
  derived and/or modified sequence opt5 from neuraminidase__InfluenzaA__EPI242475

SEQ ID NO: 209308 - RNA, 1410 nt, Artificial Sequence
  derived and/or modified sequence opt5 from neuraminidase__InfluenzaA__EPI590131
augaacgccaaucagagaaucauuaccaucggcacagugugccugauuaucgggauuaucagccuccugcuucaaaucggaaacauggucucccuguggauuucucacagcauccagacgggcgggaagaaucauaccgagauguguaaccagaauguuauuacauacgugaacaauaccugggugaaccggacauaugucaauaucuccaacaccaaaauugugaauguucaggacguggucucugugauccucacaggaaacagcucccugugcucuauuagcggcugggcuaucuacuccaaggauaauagcauccgcauugggucuaaaggagacaucuucguuauuagagaacccuuuaucuccuguagccaccuugagugccggaccuucuuucugacgcaaggcgcccuccugaacgauaagcauucuaauggcaccgugaaagaccgcuccccuuauagaacacugaugagcuguccgauuggggaagcgcccucuccuuacaacucccgguucgagagcgucgcuugguccgccucugccugccacgauggaaucggcuggcucaccaucgggauuagcggacccgacaacggcgcuguggccgugcugaaguauaaugggaucauuacagauaccaucaaguccuggcgcaacaaaauucuuagaacgcaggaaagcgagugugucugcaugaauggaucuuguuuugcuguucugacagacggcccuuccaacggccaggccagcuacaagaucuucaaagugaagcaggggaaaaucauuaagucuaucgagcucgaugcgcccaauuaucauuacgaagagugcagcuguuacccugacgccggaaaggugaugugcgucugccgggauaacuggcacgcuuccaaucgcccgugggugucuuuugaccaagaucugaacuaucagauuggcuacaucuguagcgggguuuucggagacaaucccagauccaacgacggcaaagggaauugcggaccugugcacagcaacggcgccaauggcgucaagggguuuucuuaucgguacggaaacggcguguggauugggcgcaccaaauccauccauagcagaucuggauucgaaaugauuugggaucccaauggcuggacagggaccgacuccagcuuuuccaugaagcaggauaucaucgcucuuaccgacuggucuggcuauagcggauccuucguucagcacccugagcugacaggcaugaacuguauucggcccugcuuuuggguggagcucauccgcgggcaaccgaaagaaaacacgauuugggccucuggaagcuccaucagcuucuguggcgucaauggggagaccgcgucuugguccuggccugauggagccgaccugcccuucacaauugauaaguga

SEQ ID NO: 209309 - RNA, 1410 nt, Artificial Sequence
  derived and/or modified sequence opt5 from neuraminidase__InfluenzaA__EPI68596
augaacaccaaucagagaaucauuacaaucggcacggugugccugauugucgggaucguuagccuccugcuucaaauuggaaacaucgugucccuguggaucucucacagcauucagaccggcgagaagaaucauuccgaaaucuguucucagaacgugauuacauacgagaauaacaccugggucaaucagacauaugugaacaucagcaauaccaacauugccgacgggcaaggaguuacauccaucauucucgcuggcaauucuagccugugccccaucuccgggugggccaucuacagcaaagauaacucuauucggaucggauccaagggcgacauuuucgugauccgcgaaccuuuuauuagcuguucucaccuugagugcagaaccuucuuucugacgcagggcgcgcuccugaaugaucggcauuccaacgggaccgucaaagaccgcagcccguauagaacacugaugucuugucccaucggagaagcuccuucccccuacaauagccgguucgaguccguggccuggucugccagcgcuugccacgauggcaugggguggcucaccaucggaauuuccggcccugacaacggggccguugcugugcugaaguauaacggaaucauuacagauaccaucaaaagcuggcgcaauaagauucuuagaacgcaggagucugaaugugucugcaucaacggcuccuguuuuacaaucaugaccgacggccccagcaaugggcaggccucuuacaagauuuucaaaauggagaagggaaaaaucauuaagagcguggaacuggaugcgccuaacuaucauuacgaggagugcuccuguuacccggacacaggcaaaguggucugcguuugccgggauaauuggcacgccucuaaccgccccugggugagcuuugaccaaaaucucgauuaucagaucggguacauuuguuccggaguguucggcgacaacccuagaagcaaugacgggaagggaaacugcggccccguccugucuaauggcgcuaacggggugaagggauuuuccuuccgguauggcaaugggguuuggaucggacgcaccaaaagcauuucuuccagaagcggcuuugaaaugaucugggauccuaacggguggaccgagacagacuccucuuucagcaucaagcaggauauuaucgcccuuacggacugguccggcuacucuggcagcuuugugcagcaccccgaacugaccggaaugaauuguauucggccgugcuucugggucgagcucauccgcgggcaaccuaaagaauccacaauuuggaccagcggaucuuccaucagcuucuguggcguggauucugagacagcuuccuggagcuggcccgacggggccgaucugccuuuuaccaucgacaaguga

SEQ ID NO: 209310 - RNA, 1365 nt, Artificial Sequence; identical to SEQ ID NO: 198743
  derived and/or modified sequence opt5 from neuraminidase__InfluenzaA__EPI115409

SEQ ID NO: 209311 - RNA, 1365 nt, Artificial Sequence; identical to SEQ ID NO: 198743
  derived and/or modified sequence opt5 from neuraminidase__InfluenzaA__ABD77678/m1

SEQ ID NO: 209312 - RNA, 1410 nt, Artificial Sequence; identical to SEQ ID NO: 199752
  derived and/or modified sequence opt5 from neuraminidase__InfluenzaA__EPI185224

SEQ ID NO: 209313 - RNA, 1410 nt, Artificial Sequence; identical to SEQ ID NO: 209268
  derived and/or modified sequence opt5 from neuraminidase__InfluenzaA__EPI697745

SEQ ID NO: 209314 - RNA, 1410 nt, Artificial Sequence; identical to SEQ ID NO: 209268
  derived and/or modified sequence opt5 from neuraminidase__InfluenzaA__EPI768524

SEQ ID NO: 209315 - RNA, 1410 nt, Artificial Sequence
  derived and/or modified sequence opt5 from neuraminidase__InfluenzaA__EPI726929
augaaccccaaucagaagaucauuaccaucggcagcauuuccaugacaaucgggauggccaaccugauucuccaaaucggaaauaucauuucuaucugggugagccacuccauucagaucggcaaccagucucagauugagacgugcaaucaaagcgucaucaccuacgaaaacaauacauggguuaaccagaccuaugugaauauuuccaacacaaauuucgcugccgggcagucuguggucagcgugaaacuggcgggaaacuccagccuuuguccuguuucuggcugggcuaucuacuccaaggacaauagcgugagaaucgggucuaaaggagaugucuuugugauucgggagccguucaucuccugcagcccccuggaaugucgcaccuuuuuccucacacagggcgcccugcuuaacgacaagcauucuaauggcaccauuaaagauagauccccuuaucggacgcugaugagcugccccaucggggagguuccuucccccuacaacucucgcuuugaaagcguggccugguccgcuagcgccugucacgacggaauuaacuggcucaccaucggcaucucugggccugauuccggagcugucgccgugcugaaguauaauggcauuaucacagacaccauuaagagcuggagaaacaauauccugcggacacaagagucugagugcgcgugugugaacgggagcugcuucaccauuaugacggauggaccguccgacggccaggccucuuacaaaaucuuucgcaucgaaaagggcaaaauuaucaagagcgucgagaugaaagcucccaauuaucauuacgaagaguguuccugcuacccugauagcucugagauuacauguguuugcagagacaacuggcacggguccaaucggcccugggugagcuucaaccagaaucucgaauaucagaugggauacaucugcucuggcguguuuggggauaacccucgccccaaugacaagaccggauccuguggcccggucagcuccaacggggccaauggagugaagggcuucucuuuuaaauauggcaacgggguuuggauuggaagaacaaagagcaucuccucucggaaaggcuucgagaugauuugggauccuaauggguggaccggaaccgacaacaaguuuagcaucaaacaagacaucgugggcauuaacgaaugguccggguacagcggcucuuucguccagcaucccgagcugacaggacuugauugcauccgcccuuguuucuggguggaacugauuagaggccggcccgaggagaauacgaucuggaccuccgggagcucuauuuccuuuugcggaguuaacagcgacacagugggcuggucuuggcccgauggggcugaacucccuuucaccaucgacaaguga

SEQ ID NO: 209316 - RNA, 1410 nt, Artificial Sequence; identical to SEQ ID NO: 209315
  derived and/or modified sequence opt5 from neuraminidase__InfluenzaA__EPI813816

SEQ ID NO: 209317 - RNA, 1410 nt, Artificial Sequence
  derived and/or modified sequence opt5 from neuraminidase__InfluenzaA__EPI466627
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccgucagaauugggagcaaaggagauguguuuguuauccgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucugucgccuggagcgcuuccgccugccacgacggaauuaacuggcugaccaucggcauuagcgggccugauucuggagcuguggccgugcugaaguauaauggcaucaucacagacaccauuaaguccuggagaaacaauauccuccggacacaagagagcgagugugcgugcgucaacgggucuuguuucaccauuaugacggauggaccgagcgacggccaggccuccuacaaaaucuuucgcauugaaaagggcaaaaucguuaagucuguggagaugaaugcucccaacuaucauuacgaagagugcagcuguuacccugauuccagcgagaucacaugcgugugcagagacaauuggcacgggucuaaccggcccugggucuccuucaaucagaaccuggaauaucagauuggauacaucuguagcggcguguuuggggauaauccucgccccaacgacaaaaccggaucuugcggcccgguuuccagcaauggggccaacggagugaagggcuucuccuuuaaguauggcaauggggucuggauuggaagaacaaaaucuaucagcucccggaagggcuucgagaugauuugggauccuaacggguggaccggaaccgacaacaauuuuucuaucaaacaagacauugugggcaucaacgaauggagcggguacuccggcagcuucguucagcaucccgagcuuacaggacuggauuguauccgcccuugcuucuggguggaacucauuagaggccggcccgaggagaauacgaucuggaccucuggguccagcauuucuuuuuguggagucaacuccgacacagugggcuggagcuggcccgauggggcugaacugccuuucaccaucgacaaguga

SEQ ID NO: 209318 - RNA, 1410 nt, Artificial Sequence
  derived and/or modified sequence opt5 from neuraminidase__InfluenzaA__EPI541965
augaaccccaaucagaagaucauuaccaucggcagcgugugcaugacaauugggauggccaaccugauccuccaaauuggaaauaucaucuccauuugggucucucacagcauccagcugggcaaccagucccagauugagacguguaaucaaucuguuaucaccuacgaaaacaauacaugggugaaccagaccuaugugaauauuagcaacacaaauuucgcugccgggcagccugucguguccguuaaacuugcgggaaacucuagccugugcccgguguccggcugggcuaucuacagcaaggacaauucugucagaauuggguccaaaggagauguguuuguuauccgggagcccuucaucagcuguucuccucucgaaugccgcaccuuuuuccuggcccagggcgcccuucugaacgacaagcauuccaauggcacaauuaaagauagaagccccuaucggacccucaugucuuguccuaucggggaggugcccuccccuuacaacagccgcuuugaauccgucgcuuggucugccagcgcuugccacgacggaauuaacuggcugacgaucggcauuuccgggccggauagcggagccguggcggugcugaaguauaauggcaucaucaccgacacaauuaagucuuggagaaacaauauccuccggacccaagaguccgagugugccugcgucaacgggagcuguuucacaauuaugaccgauggacccucugacggccaggcuagcuacaaaaucuuucgcauugaaaagggcaaaaucguuaaguccguggagaugaaugccccuaacuaucauuacgaagagugcucuuguuaccccgauagcuccgagaucacgugcgugugcagagacaauuggcacgggagcaaccggccuugggucucuuucaaucagaaccuggaauaucagauuggauacaucuguuccggcguguuuggggauaauccccgcccgaacgacaaaacaggaagcugcggcccuguuucuuccaauggggcuaacggagugaagggcuucagcuuuaaguauggcaauggggucuggauuggaagaaccaaauccaucucuagccggaagggcuucgagaugauuugggaucccaacggguggacaggaaccgacaacaauuuuuccaucaaacaagacauugugggcaucaacgaauggucuggguacagcggcuccuucguucagcauccugagcuuaccggacuggauuguauccgccccugcuucuggguggaacucauuagaggccggcccgaggagaauacaaucuggacgagcgggucuuccauuagcuuuuguggagucaacucugacaccgugggcugguccuggccugauggggccgaacugccguucacaaucgacaaguga

SEQ ID NO: 209319 - RNA, 1410 nt, Artificial Sequence
  derived and/or modified sequence opt5 from neuraminidase__InfluenzaA__EPI652004
augaaccccaaucagaagaucauuaccaucggcagcgugugcaugacaauugggauggccaaccugauccuccaaauuggaaauaucaucuccauuugggucucucacagcauccagauuggcaaccagucccagaucgagacguguaaucaaucuguuauuaccuacgaaaacaauacaugggugaaccagaccuaugugaauaucagcaacacaaauuucgcugccgggcaguccgucgugucuguuaaacuggcgggaaacagcucccuuugcccugugagcggcugggcuauuuacucuaaggacaauuccgucagaaucgggagcaaaggagauguguuuguuauccgggagccguucauuucuuguagcccccuggaaugccgcaccuuuuuccucgcccagggcgcccugcuuaacgacaagcauuccaauggcacaaucaaagauagaucuccuuaucggacccugauguccugucccauuggggaggugccuagccccuacaacucccgcuuugaaucugucgcuuggagcgccuccgcuugccacgacggaaucaacuggcucacgauuggcaucagcgggccugauucuggagccguggcggugcugaaguauaauggcaucauuaccgacacaaucaaguccuggagaaacaauauucugcggacccaagagagcgagugugccugcgucaacgggucuuguuucacaaucaugaccgauggaccgagcgacggccaggcuuccuacaaaauuuuucgcaucgaaaagggcaaaaucguuaagucuguggagaugaaugcccccaacuaucauuacgaagagugcagcuguuacccugauuccagcgagauuacgugcgugugcagagacaauuggcacgggucuaaccggcccugggucuccuucaaucagaaccucgaauaucagaucggauacauuuguagcggcguguuuggggauaauccucgccccaacgacaaaacaggaucuugcggcccgguuuccagcaauggggcuaacggagugaagggcuucuccuuuaaguauggcaauggggucuggaucggaagaaccaaaucuauuagcucccggaagggcuucgagaugaucugggauccuaacggguggacaggaaccgacaacaauuuuucuauuaaacaagacaucgugggcaucaacgaauggagcggguacuccggcagcuucguucagcaucccgagcugaccggacuugauuguauucgcccuugcuucuggguggaacugaucagaggccggcccgaggagaauacaauuuggacgucuggguccagcaucucuuuuuguggagucaacuccgacaccgugggcuggagcuggcccgauggggccgaacucccuuucacaauugacaaguga

SEQ ID NO: 209320 - RNA, 1410 nt, Artificial Sequence
  derived and/or modified sequence opt5 from neuraminidase__InfluenzaA__EPI62526
augaacaccaaucagagaaucauuacaaucggcacggugugccugauugucgggaucguuagccuccugcuucaaauuggaaacaucgugucccuguggaucucucacagcauucagaccggcgagaagaaucaucccgaaaucuguucccagaacgugauuacauacgagaauaacaccugggucaaucagacauaugugaacaucucuaauaccaacauuguugacgggcaaggagugacaagcaucauucucgccggcaauuccucucugugcccuaucagcgggugggcuaucuacuccaaagauaacagcauucggaucggaucuaagggcgacauuuucgucauccgcgaaccguuuauuuccuguagccaccuugagugcagaaccuucuuucugacgcagggcgcccuccugaaugaucggcauucuaacgggaccgugaaagaccgcucccccuauagaacacugaugagcuguccuaucggagaagcgcccucuccuuacaauucccgguucgagagcguugcuugguccgccucugccugccacgauggcaugggguggcucaccaucggaauuagcggccccgacaacggggcuguggccguccugaaguauaacggaaucauuacagauaccaucaaauccuggcgcaauaagauucuuagaacgcaggagagcgaaugugugugcaucaacggcucuuguuuuacaaucaugaccgacggcccuuccaaugggcaggcuagcuacaagauuuucaaaauggagaagggaaaaaucauuaagucuguggaacuggaugccccgaacuaucauuacgaggagugcagcuguuaccccgacacaggcaaagucguuugcgugugccgggauaauuggcacgcguccaaccgcccuugggugucuuuugaccaaaaucucgauuaucagaucggguacauuuguagcggagucuucggcgacaaccccagauccaaugacgggaagggaaacugcggcccugugcugagcaauggcgccaacgggguuaagggauuuucuuuccgguauggcaaugggguguggaucggacgcaccaaauccauuagcucuagauccggcuuugaaaugaucugggaucccaacggguggaccgagacagacagcuccuucucuaucaagcaggauauuaucgcucuuacggacuggagcggcuacuccggaucuuuuguccagcacccggaacugaccggcaugaauuguauucggccuugcuucuggguggagcucauccgcgggcaacccaaagaaagcacaauuuggaccuccggaagcucuaucuccuucuguggcguugauagcgagacagccucuugguccuggccugacggggcugaucugcccuuuaccaucgacaaguga

SEQ ID NO: 209321 - RNA, 1410 nt, Artificial Sequence; identical to SEQ ID NO: 199752
  derived and/or modified sequence opt5 from neuraminidase__InfluenzaA__EPI189183

SEQ ID NO: 209322 - RNA, 1410 nt, Artificial Sequence; identical to SEQ ID NO: 199752
  derived and/or modified sequence opt5 from neuraminidase__InfluenzaA__EPI180576

SEQ ID NO: 209323 - RNA, 1410 nt, Artificial Sequence
  derived and/or modified sequence opt5 from neuraminidase__InfluenzaA__EPI346918
augaacaccaaucagagaaucauuacaaucggcacggugugcaugauugucgggaucauuagccugcuccugcaaaucggaaacaucguuucccuuuggauuucucacagcauccagaccggcugggagaaucauacagaaauguguaaccagaaugugauuaccuacgugaacaauacaugggucaaccggaccuaugugaauguuuccaacacaaauaucgccaccauucaggacgugacgucuaucguccuggcugggaacagcucccucugccccgugucuggaugggccauuuacagcaaggauaauuccauccgcaucggcagcaaaggggacauuuucguuaucagagagccuuuuauuucuuguucccaacuggaaugccggaccuucuuucuuacacagggagcgcugcucaacgauaagcacagcaauggcaccgugaaagaccgcucuccguauagaacacugauguccugucccaucggcgaggcuccuagccccuacaacucucgguucgaauccgucgccuggagcgccuccgcuugccaugaugggaugggauggcugaccauuggcaucucugggccugacaacggagccguggcugugcucaaguauaauggcaucauuacggauacaaucaaaagcuggcgcaacaagauucugagaacccaggaguccgagugugucugcaugaaugggagcuguuuuacaguucuuaccgacggacccucuaacggccaggccuccuacaagaucuucaaaguggaaaagggccggauuaucaaaagcaucgagcuggaugcgccuaauuaucacuacgaagagugcucuuguuacccggacaccgggaaggugaugugcgucugccgcgauaacuggcaugccagcaauagacccuggguguccuuuaaccaaaaucucgacuaucagauuggauacaucuguucuggcguuuucggggauaacccucggagcaaugacggaaaaggcaacugcgggcccgugcuguccaauggagcuaacggcgucaagggcuuuagcuaucgcuacgggaauggaguguggauuggcagaacaaagucuaucaacucccggcgcggguucgagauuaucugggacccuaacggauggacggaaaccgauagcucuuuuuccaugaaacaggacauuaucgcccuuacagauuggagcggcuauuccgggucuuucguucagcaccccgagcugaccggcaugaauuguaucagaccgugcuuuuggguggaacucauucggggacaaccuaaggagagcacaaucugggcuuccggcucuagcauuuccuucuguggggucaacagcgaaaccgccucuugguccuggcccgacggagcggaucugccuuucacgaucgacaaauga

SEQ ID NO: 209324 - RNA, 1410 nt, Artificial Sequence; identical to SEQ ID NO: 200340
  derived and/or modified sequence opt5 from neuraminidase__InfluenzaA__EPI240976

SEQ ID NO: 209325 - RNA, 1410 nt, Artificial Sequence; identical to SEQ ID NO: 197119
  derived and/or modified sequence opt5 from neuraminidase__InfluenzaA__EPI3165

SEQ ID NO: 209326 - RNA, 1410 nt, Artificial Sequence; identical to SEQ ID NO: 209045
  derived and/or modified sequence opt5 from neuraminidase__InfluenzaA__EPI957

SEQ ID NO: 209327 - RNA, 1410 nt, Artificial Sequence; identical to SEQ ID NO: 205170
  derived and/or modified sequence opt5 from neuraminidase__InfluenzaA__EPI507593

SEQ ID NO: 209328 - RNA, 1410 nt, Artificial Sequence; identical to SEQ ID NO: 205170
  derived and/or modified sequence opt5 from neuraminidase__InfluenzaA__EPI461954

SEQ ID NO: 209329 - RNA, 1410 nt, Artificial Sequence; identical to SEQ ID NO: 205170
  derived and/or modified sequence opt5 from neuraminidase__InfluenzaA__EPI461954

SEQ ID NO: 209330 - RNA, 1410 nt, Artificial Sequence
  derived and/or modified sequence opt5 from neuraminidase__InfluenzaA__EPI668104
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuuuaccugggaaccaagcaggucugcauugccugguccucuagcuccugucacgauggcaaagccuggcuccaugugugcaucacaggcgacgauaagaacgcuaccgccagcuucauuuauaaugggcggcugguugacucuguggucuccuggagcaaagauauccuucgcacccaggagucugaaugugugugcauuaacggaacauguacgguggucaugaccgacggcaacgcuuccgggaaggccgauacaaaaauccuguuuaucgaggagggaaagauuguucacaccagcaagcucuccggcucugcgcaacauguggaagagugcagcugcuaccccagauacccuggggugcggugugucugccgcgacaauuggaaaggauccaacagacccaucguggauauuaauaucaaggaccacagcauuguuucuuccuauguguguagcggccuggucggcgacacaccgcggaaaaacgauucuagcuccucuagccacugccuugacccuaauaacgaagaagggggacauggcgugaaggggugggccuucgaugacggaaaugauguuuggaugggccgcaccaucaacgagacguccagacugggguacgagacauuuaaaguggucgagggauggagcaaucccaagucuaaacuccagaucaaccgccaggugauugucgaccggggcgauagauccggcuauagcgggaucuucucuguggaaggaaaguccuguauuaaucggugcuuuuacguugagcugaucagaggccgcaaggaagagaccgaagugcuguggaccagcaacuccauugucguguucugugggacaucuggaaccuauggcacagggagcuggccugacggcgcugaucucaaucugaugcccaucuga

SEQ ID NO: 209331 - RNA, 1410 nt, Artificial Sequence
  derived and/or modified sequence opt5 from neuraminidase__InfluenzaA__EPI578445
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcaacgcuuccgggaaggccgauacaaaaauccuguuuaucgaggagggaaagauuguucauaccagcaagcucuccggcucugcgcaacacguggaagagugcagcugcuaucccagauacccuggggugcggugugucugccgcgacaauuggaaaggauccaacagacccaucguggauauuaauaucaaggaccacagcauuguuucuuccuacguguguagcggccuggucggcgacacaccgcggaaaaacgauucuagcuccucuagccauugccuugacccuaauaacgaagaagggggacacggcgugaaggggugggccuucgaugacggaaaugauguuuggaugggccgcaccaucaacgagacguccagacugggguaugagacauuuaaaguggucgagggauggagcaaucccaagucuaaacuccagaucaaccgccaggugauugucgaccggggcgauagauccggcuacagcgggaucuucucuguggaaggaaaguccuguauuaaucggugcuuuuauguugagcugaucagaggccgcaaggaagagaccgaagugcuguggaccagcaacuccauugucguguucugugggacaucuggaaccuacggcacagggagcuggccugacggcgcugaucucaaucugaugcccaucuga

SEQ ID NO: 209332 - RNA, 1410 nt, Artificial Sequence; identical to SEQ ID NO: 209331
  derived and/or modified sequence opt5 from neuraminidase__InfluenzaA__EPI551883

SEQ ID NO: 209333 - RNA, 1410 nt, Artificial Sequence
  derived and/or modified sequence opt5 from neuraminidase__InfluenzaA__EPI344388
augaaccccaaucagaagaucauuaccaucggcagcgugucccugauuaucgccacaauuugcuuccucaugcaaaucgcuauccuggucacgaccguuacacuucacuuuaaacagcaugacuacaacucuccuccgaauaaccaggccaugcugugugagcccaccauuaucgaaagaaauacaaccgagauuguguaucucacaaacaccacgaucgaaaaggagauuugcccuaaacuggcggaauaccggaauuggagcaagccccaguguaacaucaccggguucgcuccuuuuuccaaagauaauucuauucgccuuagcgccggaggcgacaucugggugacaagagagcccuaugucuccugcgauccugacaaguguuaccaauucgcccuggggcagggaaccacacucaacaauggccacucuaacaauaccgugcaugaucggacgccguaucgcacacugcugaugaacgagcucgggguucccuuucaccugggaaccagacaggugugcauggcuuggagcuccagcucuugucaugacggcaaggccuggcuucacgucugcaucacaggcaaugauaacaacgcuaccgccuccuucauuuacaaugggcggcugguggacagcaucggaucuugguccaaaaacauucuccgcacccaggaaagcgaguguguuugcaucaauggcacauguacgguggucaugaccgaugggucugcguccggaaaggccgacacaaaaauucuguuuguggaagagggcaagaucgugcacaucagcacccuuuccgggucugcucaacaugucgaggaaugcagcugcuauccuagauuccccggaguucggugugugugccgcgauaacuggaaaggcuccaauagaccuauuguggacaucaacgucaagaauuacagcauugugucuuccuacguuuguagcggccuggugggggauacaccccggaagucugacagcgucuccucuagcuauugccucgacccgaacaaugagaaaggaggccacggggugaagggaugggccuuugaugacggcaacgauguuuggauggggcgcaccaucaaugaaacgcugagacugggauacgagacauucaaagugauugaaggcugguccaaggcuaacagcaaacuccagaccaaucggcaggucaucguggagaagggcgaccgcucuggguauuccggaaucuuuagcgucgagggcaaaucuuguauuaacagaugcuucuacguggaacugauccgggggagaaaggaggaaaccaagguuugguggacauccaauagcauuguggucuuuuguggaaccuccggcacauaugggacgggcucuuggccugauggagccgacaucaaccuuaugcccauuuga

SEQ ID NO: 209334 - RNA, 1410 nt, Artificial Sequence; identical to SEQ ID NO: 209333
  derived and/or modified sequence opt5 from neuraminidase__InfluenzaA__EPI347601

SEQ ID NO: 209335 - RNA, 1410 nt, Artificial Sequence
  derived and/or modified sequence opt5 from neuraminidase__InfluenzaA__EPI642512
augaaccccaaucagaagaucauuaccaucggcagcauuucccugaucauugccacaaucugcuuccucaugcaaaucgcuauucuggugaucacggucacccuucacuuuaaacagcauaacugugacucuagcccuaauaaccagguuauguucugcgagccgacaauuaucgaaagaaauaagaccgagauuguguaccugaucaacacaaccguggaaaaagagauuugucccaagccuacagaauaucggaauugguccaaaccccagugcaacaucaccggguuugccccuuucucuaaggauaauagcauccgccucuccgcgggaggcgacauuugggucacgagagagcccuacgugucuugugauccugacaagugcuaucaauuugcucuggggcagggaaccacacuuaacaauggccacagcaacgauaccguucaugaccggacaccguaccgcacccugcucaugaaugagcugggggugcccuuccaccugggaacgagacaggucuguaucgccugguccucuagcuccugccaugauggcaaagccuggcuccacguguguauuacaggcgacgaugggaacgcuaccgccagcuuuaucuauaauggacggcugguugacucuauuggcuccuggagcaagaacauccuucgcacacaggaaucugagugcguguguaucaacgggaccugcaccgucgugaugacagauggauccgcuagcggcaaagccgacacgaagauucuguucaucgaagaggggaaaauuauccacauuuccacccucucuggaagcgcgcaacauguggaggaaugcuccuguuacccuagauaucccggcguccggugcguuugucgcgauaauuggaagggcagcaacagaccuaucguggacaucaaugugaaggacuacucuauugucuccagcuacgugugcucugggcugguuggagauacaccccggaaaaacgacagcuuuuccucuagccacugucuugauccgaauaacgaggaaggcgggcauggagugaagggcugggccuucgacgaugggaaugacgucuggaugggacgcaccaucuccgagaaaagcagacugggcuaugaaacauuuaaggugguuaaaggcuggucugagccuaacuccaagcuccagaccaaucgccaggugauugucgggcggggaaacagaagcggcuacucugggaucuucuccauugagggcaaaaauugcaucaaccgguguuuuuauguggaacugauuagaggacgcaaggaggaaacgaaggucugguggacaagcaauuccaucgugguuuucugcgggaccucuggcaccuacggaacaggcagcuggcccgauggggcugacaucaaccugaugccuauuuga

SEQ ID NO: 209336 - RNA, 1410 nt, Artificial Sequence
  derived and/or modified sequence opt5 from neuraminidase__InfluenzaA__AIE52540
augaaccccaaucagaagaucauuaccaucggcagcgugucccugauuaucgccacaauuugcuuccucaugcaaaucgcuauccuggucacgaccguuacacuucacuuuaaacagcaugacuacaacucuccuccgaauaaccaggugaugcugugugagcccaccauuaucgaaagaaauacaaccgagauuguguaucucacaaacaucaccauugaaaaggagaucugcccuaaacuggccgaauaccggaauuggagcaagccccaguguaacauuacgggguucgcgccuuuuuccaaagauaauucuauccgccuuagcgcuggaggcgacaucugggucaccagagagcccuauguguccugcgauccugacaaguguuaccaauucgcccuggggcagggaacaacccucaacaaucggcacucuaacaauacaguucaugaucgcagcccguauagaacccugcugaugaacgagcucggcgugcccuuucaccuggggacgcggcaggucugcauugccugguccucuagcuccugucaugacggaaaggcuuggcuucacgugugcaucacaggcgaugacaauaacgccaccgcuagcuucauuuacaacggccgccugguugauucuaucggguccuggagcaaaaauauucucagaacacaggaaucugagugugugugcaucaacggaaccuguaccgucgugaugacagacggcuccgccagcgggaaggcggauacgaaaauccuguuuauugaagagggaaagaucgugcacauuuccacccuuucuggcagcgcccaacaugucgaggaaugcuccugcuauccucgguaccccgggguucgcugugugugcagagacaauuggaaaggaagcaaccggccuaucguggauauuaauaugaaggacuacucuaucgcuuccagcuaugucuguucuggccuggugggcgacacaccccgcaagaacgauagcuucuccucuagccacugccucgacccgaauaacgagaaagggggacauggcguuaaggggugggccuuugaugacggaaaugauguguggaugggcagaaccaucuccgaagaguuccggcugggguacgaaacauuuaaagucauuaagggauggagcaacccuaauucuaaacugcagaccaaccgccaggugaucguugagaagggcaauagauccggcuauagcgggguguucucuauugaggacaaauccuguaucaaccggugcuuuuacgucgaacucauuagaggacgcaaggaggaaacgaaggugugguggacaagcaauuccaucgucguguucuguggcaccucugggaccuauggaacaggcagcuggcccgauggggcugacauuaaccugaugccuaucuga

SEQ ID NO: 209337 - RNA, 1410 nt, Artificial Sequence; identical to SEQ ID NO: 209336
  derived and/or modified sequence opt5 from neuraminidase__InfluenzaA__EPI465399

SEQ ID NO: 209338 - RNA, 1410 nt, Artificial Sequence; identical to SEQ ID NO: 209336
  derived and/or modified sequence opt5 from neuraminidase__InfluenzaA__EPI328899

SEQ ID NO: 209339 - RNA, 1410 nt, Artificial Sequence; identical to SEQ ID NO: 209336
  derived and/or modified sequence opt5 from neuraminidase__InfluenzaA__EPI328901

SEQ ID NO: 209340 - RNA, 1410 nt, Artificial Sequence
  derived and/or modified sequence opt5 from neuraminidase__InfluenzaA__EPI574645
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggucacaagagagccuuaugugucuugcgacccggauaaguguuaccaauucgcucugggacagggcaccacacuuaauaacgggcauagcaauaacaccguucgggaccgcacgcccuauagaacacugcucaugaaugaacugggagugccuuuucaccugggcaccaagcaggucugcauugccugguccucuagcuccugucaugauggcaaagccuggcuccacgugugcaucacaggggacgauaagaacgcuaccgccagcuucauuuacaauggacggcugguugacucuguggucuccuggagcaaagauauccuucgcacccaggagucugaaugugugugcauuaacggcacauguacgguggucaugaccgacggguccgcuagcggaaaggccgauacaaaaauccuguuuaucgaggagggcaagauuauccauaccuccacacucucugggagcgcgcaacacguugaagagugcuccugcuaucccagauacccuggagugcggugugugugccgcgacaacuggaagggcagcaauagacccauugucgauaucaacauuaaagaccacucuaucguguccagcuacguuuguucuggccuggugggggacaccccgcggaagaaugauagcuccucuagcucccauugccuugacccuaacaaugaagagggaggccacggggucaaaggaugggccuucgaugacggcaacgauguguggauggggcgcacgaucaaugaaacaagcagacugggauaugagaccuuuaagguuauugagggcuggucuaaccccaaauccaagcuccagaucaaucgccaggugauugucgaccggggcgauagaagcggguacucuggaaucuucuccguggaaggcaaaagcuguauuaaccggugcuuuuaugucgagcugaucagagggcgcaaggaagagaaugaagugcuguggaccuccaacucuauuguuguguucuguggaacaagcggcaccuacgggacaggcuccuggccugacggagcugaucucaaucugaugcccaucuga

SEQ ID NO: 209341 - RNA, 1410 nt, Artificial Sequence
  derived and/or modified sequence opt5 from neuraminidase__InfluenzaA__EPI563214
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucaguguucuauuaccggguucgcccccuuuagcaaagacaacuccauccgccucucugcgggaggcgauaucugggugacaagagagccuuaugucagcugcgacccggauaaguguuaccaauucgcucuggggcagggaaccacacuuaauaacgugcauuccaauaacaccguucgggaccgcacgcccuauagaacacugcucaugaaugaacugggcgugccuuuucaccuggggaccaagcaggucugcauugccuggucuagcuccagcugucaugauggaaaagccuggcuccacgugugcaucacaggcgacgauaagaacgcuaccgccucuuucauuuacaauggccggcugguugacuccguggucagcuggucuaaagauauccuucgcacccaggaguccgaaugugugugcauuaacgggacauguacgguggucaugaccgacggaagcgcuuccggcaaggccgauacaaaaauccuguuuaucgaggaggggaagauuguuuauaccucuaagcucagcggauccgcgcaacauguggaagagugcagcugcuaccccagauacccuggcgugcggugugucugccgcgacaacuggaaagggucuaauagacccaucguggauauuaacaucaaggaccacuccauuguuagcucuuauguguguagcggacuggucggcgacacaccgcggaaaaaugauuccucuagcuccagccacugccuugacccuaacaaugaagagggcgggcauggagugaagggcugggccuucgaugacgggaacgauguuuggaugggacgcaccaucaaugaaacgucuagacugggcuacgagacauuuaaaguggucgaggggugguccaaccccaagagcaaacuccagaucaaucgccaggugauugucgaccggggagauagaucuggcuauuccggcaucuucagcguggaagggaaguccuguauuaaccggugcuuuuacguugagcugaucagaggacgcaaggaagagaccgaagugcuguggaccucuaauagcauugucguguucuguggcacauccgggaccuauggaacaggcucuuggccugacggggcugaucucaaccugaugcccaucuga

SEQ ID NO: 209342 - RNA, 1410 nt, Artificial Sequence; identical to SEQ ID NO: 209341
  derived and/or modified sequence opt5 from neuraminidase__InfluenzaA__EPI553998

SEQ ID NO: 209343 - RNA, 1410 nt, Artificial Sequence
  derived and/or modified sequence opt5 from neuraminidase__InfluenzaA__EPI551568
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucaguguucuauuaccggguucgcccccuuuagcaaagacaacuccauccgccucucugcgggaggcgauaucugggugacaagagagccuuaugucagcugcgacccggauaaguguuaccaauucgcucuggggcagggaaccacacuuaauaacgugcauuccaauaacauuguucgggaccgcacccccuauagaacgcugcucaugaaugaacugggcgugccuuuucaccuggggacaaagcaggucugcaucgccuggucuagcuccagcugucaugauggaaaagccuggcuccacgugugcauuaccggcgacgauaagaacgcuacagccucuuucaucuacaauggccggcugguugacuccguggucagcuggucuaaagauauucuucgcacccaggaguccgaaugugugugcaucaacgggaccuguacaguggucaugacggacggaagcgcuuccggcaaggccgauaccaaaauccuguuuauugaggaggggaagaucguuuauacaucuaagcucagcggauccgcgcaacauguggaagagugcagcugcuaccccagauacccuggcgugcggugugucugccgcgacaacuggaaagggucuaauagacccauuguggauaucaacauuaaggaccacuccaucguuagcucuuauguguguagcggacuggucggcgacaccccgcggaaaaaugauuccucuagcuccagccacugccuugacccuaacaaugaagagggcgggcauggagugaagggcugggccuucgaugacgggaacgauguuuggaugggacgcacaaucaaugaaaccucuagacugggcuacgagacguuuaaaguggucgaggggugguccaaccccaagagcaaacuccagauuaaucgccaggugaucgucgaccggggagauagaucuggcuauuccggcauuuucagcguggaagggaaguccuguaucaaccggugcuuuuacguugagcugauuagaggacgcaaggaagagacagaagugcuguggaccucuaauagcaucgucguguucuguggcaccuccgggacauauggaaccggcucuuggccugacggggcugaucucaaccugaugcccauuuga

SEQ ID NO: 209344 - RNA, 1410 nt, Artificial Sequence
  derived and/or modified sequence opt5 from neuraminidase__InfluenzaA__EPI629737
augaaccccaaucagaagaucauugccaucggcagcgugucccugaccauuucuacaaucugcuucuuuaugcaaauugcuauccucaucacgaccgucacacugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacccgccgaguaccggaauugguccaagccucaguguucuauuacgggguucgcgcccuuuagcaaagacaacuccauccgccucucugcuggaggcgauaucugggugaccagagagccuuaugucagcugcgacccggauaaguguuaccaauucgcccuggggcagggaacaacccuuaauaacgugcauuccaauaacacaguucgggaccgcacccccuauagaacgcugcucaugaaugaacugggcgugccuuuucaccuggggacaaagcaggucugcauugccuggucuagcuccagcugucaugauggaaaggcuuggcuccacgugugcaucaccggcgacgauaaaaacgccacagcuucuuucauuuacaauggccggcugguugacuccguggucagcuggucuaaagauauccuucgcacccaggaguccgaaugugugugcauuaacgggaccuguacaguggucaugacggacggaagcgccuccggcaaggcggauaccaaaauccuguuuaucgaggaggggaagauuguuuauacaucuaagcucagcggauccgcccaacauguggaagagugcagcugcuaccccagauacccuggcgugcggugugucugccgcgacaacuggaaagggucuaauagacccaucguggauauuaacaucaaggaccacuccauuguuagcucuuauguguguagcggacuggucggcgacaccccgcggaaaaaugauuccucuagcuccagccacugccuugacccuaacaaugaagagggcgggcauggagugaagggcugggcuuucgaugacgggaacgauguuuggaugggacgcacaaucaaugaaaccucuagacugggcuacgagacguuuaaaguggucgaggggugguccaaccccaagagcaaacuccagaucaaucgccaggugauugucgaccggggagauagaucuggcuauuccggcaucuucagcguggaagggaaguccuguauuaaccggugcuuuuacguugagcugaucagaggacgcaaggaagagacagaagugcuguggaccucuaauagcauugucguguucuguggcaccuccgggacauauggaaccggcucuuggccugacggggccgaucucaaccugaugcccaucuga

SEQ ID NO: 209345 - RNA, 1410 nt, Artificial Sequence; identical to SEQ ID NO: 209341
  derived and/or modified sequence opt5 from neuraminidase__InfluenzaA__EPI631886

SEQ ID NO: 209346 - RNA, 1410 nt, Artificial Sequence; identical to SEQ ID NO: 209341
  derived and/or modified sequence opt5 from neuraminidase__InfluenzaA__EPI577025

SEQ ID NO: 209347 - RNA, 1410 nt, Artificial Sequence; identical to SEQ ID NO: 206895
  derived and/or modified sequence opt5 from neuraminidase__InfluenzaA__EPI404926

SEQ ID NO: 209348 - RNA, 1410 nt, Artificial Sequence; identical to SEQ ID NO: 206895
  derived and/or modified sequence opt5 from neuraminidase__InfluenzaA__EPI492687

SEQ ID NO: 209349 - RNA, 1410 nt, Artificial Sequence
  derived and/or modified sequence opt5 from neuraminidase__InfluenzaA__EPI530648
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagaccaaucggcaggucauuguggaccgcggcgauagaagcggcuacucugggaucuucuccgucgaaggaaaaagcuguauuaaccggugcuuuuauguggagcugaucagaggccgcaaggaagagacagaaguucuguggaccuccaauucuauuguggucuucugugggacaagcggaacguacggcaccggguccuggccugacggcgcugaucucaaccugaugcccaucuga

SEQ ID NO: 209350 - RNA, 1410 nt, Artificial Sequence; identical to SEQ ID NO: 209331
  derived and/or modified sequence opt5 from neuraminidase__InfluenzaA__EPI684314

SEQ ID NO: 209351 - RNA, 1410 nt, Artificial Sequence
  derived and/or modified sequence opt5 from neuraminidase__InfluenzaA__EPI614459
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcccgcugaauaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugagcugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggauauccuucgcacccaggaaucugagugugugugcauuaacggaacauguacgguggucaugaccgacggcuccgcuagcgggaaagccgauacaaagauccuguuuaucgaagagggaaagauuguucauaccuccacacucucuggcagcgcgcaacacguggaggaaugcuccugcuaucccagauacccuggggugcggugugucugccgcgacaacuggaaaggaagcaauagacccaucguggauauuaacaucaaggaccacucuauuguuuccagcuacguguguucuggccuggucggcgacaccccgcggaaaaaugauagcuccucuagcucccauugccuugacccuaacaaugaggaagggggacacggcgugaaggggugggccuucgaugacggaaacgauguuuggaugggccgcacgaucaaugagacaagcagacugggguaugaaaccuuuaaagugaucgagggauggucuaaccccaaguccaaacuccagaccaaucggcaggucauuguggaccgcggcgauagaagcggcuacucugggaucuucuccgucgagggaaagagcuguauuaaccggugcuuuuauguggaacugaucagaggccgcaaggaggaaacagagguucuguggaccuccaauucuauuguggucuucugugggacaagcggaacguacggcaccggguccuggccugacggcgcugaucucaaccugaugcccaucuga

SEQ ID NO: 209352 - RNA, 1410 nt, Artificial Sequence; identical to SEQ ID NO: 209351
  derived and/or modified sequence opt5 from neuraminidase__InfluenzaA__EPI541466

SEQ ID NO: 209353 - RNA, 1410 nt, Artificial Sequence; identical to SEQ ID NO: 209351
  derived and/or modified sequence opt5 from neuraminidase__InfluenzaA__EPI696968

SEQ ID NO: 209354 - RNA, 1410 nt, Artificial Sequence; identical to SEQ ID NO: 209351
  derived and/or modified sequence opt5 from neuraminidase__InfluenzaA__EPI674598

SEQ ID NO: 209355 - RNA, 1410 nt, Artificial Sequence; identical to SEQ ID NO: 209349
  derived and/or modified sequence opt5 from neuraminidase__InfluenzaA__EPI530678

SEQ ID NO: 209356 - RNA, 1410 nt, Artificial Sequence
  derived and/or modified sequence opt5 from neuraminidase__InfluenzaA__EPI530680
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagauauccuucgcacccaggagucugaaugugugugcauuaacggaacauguacgguggucaugaccgacggcuccgcuagcgggaaggccgauacaaaaauccuguuuaucgaggagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgacaccccgcggaagaaugauagcuccucuagcucccauugccuugacccuaacaaugaagaagggggacacggcgugaaagggugggccuucgaugacggaaacggcguuuggauggggcgcacgaucaaugagacaagcagacugggauaugagaccuuuaaggugaucgagggcuggucuaaccccaaauccaagcuccagaccaaucggcaggucauuguggaucgcggcgacagaagcggguacucuggaaucuucuccgucgaaggcaaaagcuguauuaaccggugcuuuuauguggagcugaucagagggcgcaaggaagagacagaaguucuguggaccuccaauucuauuguggucuucuguggaacaagcggcacguacgggaccggcuccuggccugauggagcugaccucaaccugaugcccaucuga

SEQ ID NO: 209357 - RNA, 1410 nt, Artificial Sequence; identical to SEQ ID NO: 197062
  derived and/or modified sequence opt5 from neuraminidase__InfluenzaA__EPI7603

SEQ ID NO: 209358 - RNA, 1410 nt, Artificial Sequence; identical to SEQ ID NO: 209349
  derived and/or modified sequence opt5 from neuraminidase__InfluenzaA__EPI814527

SEQ ID NO: 209359 - RNA, 1410 nt, Artificial Sequence; identical to SEQ ID NO: 209349
  derived and/or modified sequence opt5 from neuraminidase__InfluenzaA__EPI674737

SEQ ID NO: 209360 - RNA, 1410 nt, Artificial Sequence; identical to SEQ ID NO: 209349
  derived and/or modified sequence opt5 from neuraminidase__InfluenzaA__EPI614443

SEQ ID NO: 209361 - RNA, 1410 nt, Artificial Sequence; identical to SEQ ID NO: 209349
  derived and/or modified sequence opt5 from neuraminidase__InfluenzaA__EPI551812

SEQ ID NO: 209362 - RNA, 1410 nt, Artificial Sequence; identical to SEQ ID NO: 209349
  derived and/or modified sequence opt5 from neuraminidase__InfluenzaA__EPI696961

SEQ ID NO: 209363 - RNA, 1410 nt, Artificial Sequence; identical to SEQ ID NO: 209349
  derived and/or modified sequence opt5 from neuraminidase__InfluenzaA__EPI740789

SEQ ID NO: 209364 - RNA, 1410 nt, Artificial Sequence
  derived and/or modified sequence opt5 from neuraminidase__InfluenzaA__EPI377498
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucacgaccggacgcccuaucgcacacugcucaugaaugaacugggggugccuuuucaucugggaaccaagcaggucugcauugccugguccucuagcuccugucacgauggcaaagccuggcuccaugugugcaucacaggcgacgauaagaacgcuaccgccagcuucauuuacaaugggagacugguugacucuguggucuccuggagcaaagagauccuucggacccaggaaucugagugugugugcauuaacggaacauguacgguggucaugaccgauggcuccgcuagcgggaaggccgacacaaaaauccuguuuaucgaggaaggaaagauuguucacaccuccacacucucuggcagcgcgcaacacguggaggaaugcuccugcuauccccgcuacccuggggugagaugugucugccgggauaacuggaagggaagcaaucgccccaucguggacauuaacaucaaagaucauucuauuguuuccagcuacguguguucuggccuggucggcgacaccccgagaaagaaugacagcuccucuagcucccacugccuugauccuaacaaugaggaagggggacauggcgugaaagggugggccuucgacgauggaaacgacguuuggaugggccggacgaucaaugagacaagccgccugggguaugagaccuuuaaggugaucgaaggauggucuaaccccaaauccaagcuccagauuaauagacaggucaucguggaucggggcgaccgcagcggcuacucugggauuuucuccgucgagggaaaaagcuguaucaacagaugcuuuuauguggaacugauucggggcagaaaggaggaaaccgagguucuguggacauccaauucuaucguggucuucugugggaccagcggaacauacggcacgggguccuggccugauggcgcugaccucaaccugaugcccauuuga

SEQ ID NO: 209365 - RNA, 1410 nt, Artificial Sequence; identical to SEQ ID NO: 209364
  derived and/or modified sequence opt5 from neuraminidase__InfluenzaA__EPI377498

SEQ ID NO: 209366 - RNA, 1410 nt, Artificial Sequence; identical to SEQ ID NO: 209364
  derived and/or modified sequence opt5 from neuraminidase__InfluenzaA__EPI391246

SEQ ID NO: 209367 - RNA, 1410 nt, Artificial Sequence; identical to SEQ ID NO: 209364
  derived and/or modified sequence opt5 from neuraminidase__InfluenzaA__EPI407122

SEQ ID NO: 209368 - RNA, 1410 nt, Artificial Sequence; identical to SEQ ID NO: 209364
  derived and/or modified sequence opt5 from neuraminidase__InfluenzaA__EPI407125

SEQ ID NO: 209369 - RNA, 1410 nt, Artificial Sequence; identical to SEQ ID NO: 209331
  derived and/or modified sequence opt5 from neuraminidase__InfluenzaA__EPI562038

SEQ ID NO: 209370 - RNA, 1410 nt, Artificial Sequence; identical to SEQ ID NO: 209331
  derived and/or modified sequence opt5 from neuraminidase__InfluenzaA__EPI562038

SEQ ID NO: 209371 - RNA, 1410 nt, Artificial Sequence; identical to SEQ ID NO: 205641
  derived and/or modified sequence opt5 from neuraminidase__InfluenzaA__EU716525

SEQ ID NO: 209372 - RNA, 1350 nt, Artificial Sequence
  derived and/or modified sequence opt5 from neuraminidase__InfluenzaA__EPI232422
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccgugaaagaucgcuccccucauagaacacucaugagcugccccgucggcgaggccccuucucccuauaauucccgguuugaaagcguggcuugguccgccucugcuugucacgacgggaccagcuggcugacgaucggaauuuccggcccugauaacggggccguugcggugcugaaguacaauggaaucauuaccgacacaaucaagagcuggcgcaacaauauucucagaacccaggagucugagugcgccugugucaacggcuccugcuucacagugaugaccgaugggccgagcucuggacaggcuagcuauaaaaucuuuaagauggaaaaaggcaagguggucaaauccguugagcuggacgcccccaauuaccauuaugaagaguguucuugcuacccugaugcuggcgagaucacgugugugugccgggacaacuggcacgggagcaaccgccccuggguguccuucaaucagaaccuugaauaucaaauuggauacaucugcagcggcgucuuuggggauaauccuagacccaacgacggaacaggcucuugugggccgguguccccuaauggagccuacggcguuaagggcuucagcuuuaaguaugggaacggaguguggauuggccggaccaaaucuacaaauucccgcagcggguucgagaugaucugggaucccaacggauggaccggcaccgacuccucuuuuagcgucaagcaggacauuguggcgaucacagauugguccggguacucuggcagcuucguucagcacccugaacugacgggacucgacugcaucagacccuguuucuggguggagcugauucggggccgccccaaagaauccaccaucuggacaagcgggucuuccauuagcuuuugcggagucaauucugauaccguguccuggagcuggccugacggcgccgagcuuccguucacaaucgauaaguga

SEQ ID NO: 209373 - RNA, 1350 nt, Artificial Sequence; identical to SEQ ID NO: 209208
  derived and/or modified sequence opt5 from neuraminidase__InfluenzaA__EPI227593

SEQ ID NO: 209374 - RNA, 1350 nt, Artificial Sequence
  derived and/or modified sequence opt5 from neuraminidase__InfluenzaA__EPI435658
augaaccccaaucagaagaucgugaccauuggcagcaucugcauggucauugggaucauuucccugaugcuccaaaucggaaacaucauuucuaucuggguuagccacuccauucagacaggcaaucagcaucagacggagccuaucagaaacaccaauuuccugacagaaaacgccguggcuucugugacccuugccgggaauagcucccuguguccgauucggggaugggcgguccacucuaaagacaacagcauccgcauuggcuccaagggggauguguuuguuaucagagagcccuucaucagcugcucucaucucgaaugucggacauuuuuccugacccaaggagcccuucugaaugacaaacacuccaacggcacagugaaggaucgcagcccucauagaacccucaugucuugccccauuggcgaggcuccuucccccuacaauagccgguuugaaucugucgccugguccgcuagcgccugucacgacgggacguccuggcugaucauuggaaucucuggcccugauaacggggcuguggccguucugaaauauaauggaauuaucaccgacacaaucaagagcuggcgcaacaauauucucagaacccaggaguccgagugcgcgugugugaacggcagcugcuucacagucaugaccgaugggccgucuaacggacaggccuccuacaagaucuuuaaaauugaaaagggcaaaguggucaagagcguggagcugaaugcucccaacuaucacuacgaagaguguucuugcuauccugacgccggcgagaucauuuguguuugccgggauaauuggcaugggagcaaccgccccuggguguccuucaaucagaaccuugaauaccaaaucggauauaucugcucuggcguguuuggggacaauccuagacccaacgauggaacgggcagcugugggccggucuccccuaauggagcuuacggcgugaaaggcuucagcuuuaaguacgggaacggaguuuggauuggccggacaaagucuacccacucccgcagcggguucgagaugaucugggaccccaauggauggacaggcaccgauucugaauuuuccaugaaacaggacauuguggccaucaccgacuggagcggguauuccggcucuuucguccagcauccugagcugacaggacucgauugcauuagacccuguuucuggguggaacugauccggggccgccccaaggagagcacgauuuggaccuccgggucuagcaucuccuuuugcggaguuaacagcgacacagugucuugguccuggccugauggcgcggagcuuccguucaccaucgacaaauga

SEQ ID NO: 209375 - RNA, 1350 nt, Artificial Sequence; identical to SEQ ID NO: 209374
  derived and/or modified sequence opt5 from neuraminidase__InfluenzaA__EPI492513

SEQ ID NO: 209376 - RNA, 1350 nt, Artificial Sequence; identical to SEQ ID NO: 202721
  derived and/or modified sequence opt5 from neuraminidase__InfluenzaA__EPI165066

SEQ ID NO: 209377 - RNA, 1350 nt, Artificial Sequence
  derived and/or modified sequence opt5 from neuraminidase__InfluenzaA__EPI531308
augaaccccaaucagaagaucauuaccaucggcagcauuugcauggugacaggggucguuucccugaugcuccaagugggaaacaugaucucuauuuggaucagccacuccauccauacgggcaaucagcaccaggccgagccuauuucuaacaccaauuuccauacagaaaaagcuguggucagcgccaagcuggcggggaacuccucucuuuguccgaucaauggaugggcuguguacagcaaagacaacuccauuagaaucggcagcaagggggauguuuuugugauucgggagcccuucaucucuugcucccaccuggaaugucgcaccuuuuuccucacacagggagcccugcuuaaugacaaacauagcaacggcaccgccaaggauagaucuccucaccggacacugauguccugccccgucggcgaggcuccuagccccuauaauucucgcuuugaauccguggccuggagcgcuuccgccugucacgacgggaccucuuggcucacgauuggaaucagcggcccugauaacggggcgguugccgugcugaaguacaauggaaucauuaccgacacaaucaaauccuggagaaacaauguccugcggacccaagagagcgagugcgcuugugugaacggcuauugcuucacagugaugaccgaugggccgucuaacggacaggccucccauaagauuuuuaaaauggaaaagggcaaagucaucaagagcguugagcucgacgcucccaauuaccacuaugaagaguguucuugcuacccugaugccggcgagauuacgugugugugccgcgacaacuggcaugggagcaauagacccuggaucuccuucaaccagaaucuggaauaucagaucggauacauuugcucuggcguguuuggggauaacccucggcccaaugacggaaagggcagcugugggccggucuccagcaacggagcguacggcgugaaaggcuucucuuuuaaguaugggaauggaguuuggaucggccgcacaaaauccaccaacagcagaucuggguucgagaugauuugggauccuaauggauggacagaaaccgacuccagcuuuuccgugaagcaagacaucgucgccauuaccgauuggucuggcuacagcggguccuucgugcagcaccccgagcuuacaggccuggacugcauccggccuuguuucuggguugaacucauccgcggaagacccaaagagggcacgauuuggaccucugggagcuccaucagcuuuugcggagugucuggcgauacagucgggugguccuggcccgacggagcugagcugccuuucaccauugauaaguga

SEQ ID NO: 209378 - RNA, 1350 nt, Artificial Sequence
  derived and/or modified sequence opt5 from neuraminidase__InfluenzaA__EPI433308
augaaccccaaucagaagaucauuaccaucggcagcauuugcauggugaucgggauugucucccugaugcuccaaaucggaaaccugaucucuauuuggguuagccacuccauccagagaggcaaucuuaaccagguggagccuauuucuaauacauccuucccgacggaaaaagccguggcuuccgucacccuggccgggaacucuagccucugucccauccggggaugggcggugcauuccaaggacaauagcauucgcaucggcucuaaaggggauguuuuugugauuagagagccuuucaucuccugcagccaccuggaaugucggacauuuuuccuuacccagggagcucugcucaacgacaagcauucuaauggcacagucaaagaucgcagcccccacagaacccugaugagcugcccugugggcgaggcccccucuccuuacaacucccgguuugaaagcguugccugguccgcuucugccugucaugacgggacaagcuggcugaccaucggaauuuccggcccggauaauggggcuguggccgucgugaaguauaacggaaucauuacggacaccaucaagagcuggggcaauaacauucuccgcacacaagagucugagugcgcgugugugaauggguccugcuucaccgucaugacagauggacccagcaacggccaggccucuuacaaaaucuuuaagauggaaaaaggcaagguuaucaaaagcguggagcuggacgcuccuaacuaucacuacgaagaguguuccugcuaucccgaugccggggagauuaccugugugugcagagacaauuggcacggaucuaaccggccuugggucagcuucaaucagaaccuugaauaccagaucggcuauauuugcuccgggguguuuggagauaauccccgcccgaacgacggcacggggagcuguggaccuguuucucccaauggcgcuuacggcgugaagggguucuccuuuaaguacggaaacggcgucuggaucgggagaacaaaaagcccuaauucucgguccggauucgagaugauuugggaucccaacggcuggagcgaaaccgacuccucuuuuagcgugaagcaagacauccuggccguuacagauugguccggguauucuggcagcuucgugcagcaucccgagcucaccggacuggacugcauccgcccuuguuucugggucgaacuuauuagaggccggccggaggaguccaccaucuggacaagcgggucuuccauuagcuuuugcggagucaauucugauacgguguccuggagcuggcccgacggcgcggaacugccuuucaccaucgauaaauga

SEQ ID NO: 209379 - RNA, 1350 nt, Artificial Sequence
  derived and/or modified sequence opt5 from neuraminidase__InfluenzaA__EPI114974
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccgugaaagaucgcuccccucauagaacacucaugagcugccccgucggcgaggccccuucucccuauaauucccgguuugaaagcguggcuugguccgccucugcuugucacgacgggaccagcuggcugacgaucggaauuuccggcccugauaacggggccguugcggugcugaaguacaauggaaucauuaccgacacaaucaagagcuggcgcaacaauauucucagaacccaggagucugagugcgccugugucaacggcuccugcuucacagugaugaccgaugggccgagcaauggacaggcuucuuauaaaaucuuuaagauggaaaaaggcaagguggucaaaagcaucgagcuggacgcccccaacuaccauuaugaagaguguuccugcuacccugaugcuggcgagauuacguguguuugccgggacaacuggcacgggucuaaucgccccugggugagcuucaaccagaaucuugaauaucaaaucggauacauuugcuccggcguguuuggggauaacccuagacccaaugacggaacaggcagcugugggccggucucuccuaacggagccuacggcgugaagggcuucuccuuuaaguaugggaauggaguuuggaucggccggaccaaaagcacaaacucucgcuccggguucgagaugauuugggaucccaauggauggaccggcaccgacagcuccuuuucugugaagcaggacaucgucgcgaucacagauuggagcggguacuccggcucuuucgugcagcacccugaacugacgggacucgacugcauuagacccuguuucuggguugagcugauccggggccgccccaaagaaagcaccauuuggacauccgggagcucuaucuccuuuugcggagugaacagcgauaccgucucuugguccuggccugacggcgccgagcuuccguucacaauugauaaguga

SEQ ID NO: 209380 - RNA, 1350 nt, Artificial Sequence
  derived and/or modified sequence opt5 from neuraminidase__InfluenzaA__EPI622495
augaaccccaaucagaagaucaccacaauuggcagcaucugcauggugauugggaucgucucccugaugcuccaaauuggaaacaugguuucuaucugggugagccacuccauccagacgagaaaucagcggcaggccgagccuauuucuaacacccgcagccugacagaaaaagcuguggccuccgucacccuugcgggcaauucuagccuguguccgaucuccgggugggcuguguacagcaaggacaacucuauuagaaucggauccaaaggcgauguuuucgugauucgggagcccuuuaucagcugcucucaucucgaaugucgcacauucuuucugacccaaggggcccuucugaaugacaagcacuccaacggaacagucaaagauagaagcccucaucggacccucaugucuugccccgugggcgaggccccuucccccuauaauagccgcuucgaauccguugcuuggucugccagcgcuugucacgacggcacguccuggcugaccauugggaucagcggaccugauaacggcgccguggcggucgugaaguacaaugggaucauuacagacaccaucaagucuuggagaaacaauauucugcggacacaggaguccgagugcgugugugucaacggaagcugcuuuaccguuaugacggauggcccgucuaauaaacaggccagcuauaagaucuucaaaauggaaaaggggaaaguggugaaguccauugagcucgacgcucccaacuaccauuaugaagaguguucuugcuacccugaugccggagagaucacaugugucugccgcgacaacuggcacggcagcaauagacccuggcuguccuuuaaccagaaucuugaauaucaaaucggcuacauuugcagcgggguguucggagauaacccucggcccaaugacggcaccgggucuuguggaccgguuuccagcaacggcgcuuacggggugaagggauuuucuuucaaauauggcaauggcgucuggaucgggcgcacaaaguccaccaacagcagauccggauuugagaugauuugggauccuaauggcuggaccgggacagacucuagcuucuccaugaaacaggacaucguggccauuacggauuggucuggauacagcggcuccuuuguucagcaccccgaacugaccgggcucgacugcauccggccuuguuucuggguggagcugguccgcggcagacccaaggaaggaacaaucuggaccagcgggucuuccauuagcuucugcggcgugaacucugauacagucuccuggagcuggcccgacggagcggagcuuccuuuuaccaucgauaaauga

SEQ ID NO: 209381 - RNA, 1350 nt, Artificial Sequence
  derived and/or modified sequence opt5 from neuraminidase__InfluenzaA__EPI349847
augaaccccaaucagaagaucaccacaauuggcagcaucugcauggugauugggaucgucucccugaugcuccaaauuggaaacaugguuucuaucugggugagccacuccauccagacgagaaaucagcggcaggccgagccuauuucuaacacccgcagccugacagaaaaagcuguggccuccgucacccuugcgggcaauucuagccuguguccgaucuccgggugggcuguguacagcaaggacaacucuauuagaaucggauccaaaggcgauguuuucgugauucgggagcccuuuaucagcugcucucaucucgaaugucgcacauucuuucugacccaaggggcccuucugaaugacaagcacuccaacggaacagucaaagauagaagcccucaucggacccucaugucuugccccgugggcgaggccccuucccccuauaauagccgcuucgaauccguugcuuggucugccagcgcuugucacgacggcacguccuggcugaccauugggaucagcggaccugauaacggcgccguggcggucgugaaguacaaugggaucauuacagacaccaucaagucuuggagaaacaauauucugcggacacaggaguccgagugcgugugugucaacggaagcugcuuuaccguuaugacggauggcccgucuaauaaacaggccagcuauaagaucuucaaaauggaaaaggggaaaguggugaaguccauugagcucgacgcucccaacuaccauuaugaagaguguucuugcuacccugaugccggagagaucacaugugucugccgcgacaacuggcacggcagcaauagacccuggcuguccuuuaaccagaaucuugaauaucaaaucggcuacauuugcagcgggguguucggagauaacccucggcccaaugacggcaccgggucuuguggaccgguuucccacaacggcgcuuacggggugaagggauuuagcuucaaauauggcaauggcgucuggaucgggcgcacaaagucuaccaacuccagaagcggauuugagaugauuugggauccuaauggcuggaccgggacagacuccucuuucagcaugaaacaggacaucguggccauuacggauugguccggauacucuggcagcuuuguucagcaucccgaacugaccgggcucgacugcauccggccuuguuucuggguggagcugguccgcggcagacccaaggaaggaacaaucuggaccuccggcagcucuauuuccuucugcggggugaacagcgauacagucucuugguccuggcccgacggagcggagcuuccuuuuaccaucgauaaauga

SEQ ID NO: 209382 - RNA, 1350 nt, Artificial Sequence
  derived and/or modified sequence opt5 from neuraminidase__InfluenzaA__EPI174804
augaaccccaaucagaagaucauuaccaucggcagcauuugcauggugaucgggauugucucccugaugcuccaaaucggaaacaugguuucuaucugggugagccacuccauucagacaagaaaucagcggcaggccgagccuaucucuaacacgaaaagccugaccgaaaaggcuguggccuccgucacacuugcgggcaauucuagccuguguccgauuuccgggugggcuguguacagcaaagacaacucuauccgcauuggauccaagggcgauguuuucgugaucagagagcccuuuauuagcugcucucaucucgaaugucggaccuucuuucugacacaaggggcccuucugaaugacaaacacuccaacggaaccaucaaggaucgcagcccucauagaacacucaugucuugccccgucggcgaggccccuucccccuauaauagccgguucgaauccguggcuuggucugccagcgcuugucacgacggcaccuccuggcugacgaucgggauuagcggaccugauaacggcgccguugcggugcugaaguacaaugggaucauuaccgacacaaucaaaucuuggcgcaacaauauucucagaacccaggaguccgagugcgccugugucaacggaagcugcuuugcugugaugacagauggcccgucuaaucggcaggccagcuauaagaucuucaaaauggaaaaggggaaaguggucaaguccaucgagcuggacgcucccaacuaccauuaugaagaguguucuugcuacccugaugccggagagauuaccuguguuugccgcgacaacuggcacggcagcaauagacccuggcuuuccuuuaaccagaaucuggaauaucaaaucggcuacauuugcagcgggguguucggagauaacccucggcccaaugacggcacggggucuuguggaccgguguccagcaacggcgcguacggggucaagggauuuucuuucaaauauggcaauggcguguggaucgggcgcacaaaguccaccaacagcagauccggauuugagaugauuugggauccuaauggcuggacagaaaccgacucuagcuucuccaugaaacaggacaucguugccaucaccgauuggucuggguacagcggauccuuugugcagcaccccgagcucacaggccuggacugcauucggccuuguuucugggucgaacuugugcgcgggagacccaaggagagcacgaucuggaccucuggcuccagcauuucuuucugcggaguuaacuccgauacagugagcuggucuuggcccgacggcgcugagcugccuuuuaccaucgauaaauga

SEQ ID NO: 209383 - RNA, 1350 nt, Artificial Sequence
  derived and/or modified sequence opt5 from neuraminidase__InfluenzaA__EPI492441
augaaccccaaucagaagaucauggccauuggcagcgugugcauggucaucgggauuguuucccugaugcuccaaaucggaaacaccauuucuaucugggugagccacuccuuccagacaagagugcagcaucaggcugagccuauccggaauacgaacuuucugaccgaaaaugccgucgcgucugugacacuugcuggcaacagcucccuguguccgauucgcgggugggccguucacucuaaagacaauagcaucagaauuggauccaagggcgauguguucgucauccgggagcccuuuauuagcugcucucaucucgaaugucgcaccuucuuucugacacaaggggcccuucugaacgacaaacacuccaauagaaccgugaaggaucggagcccucaucgcacacucaugucuugccccguuggagaggugccuucccccuacaacagcagauucgaaucugucgcuugguccgccagcgcuugucacgacggcaccuccuggcugacgaucggcauuucugggccugauaauggagccguggcggugcugaaauauaacggcaucaucaccgacacaauuaagagcuggcggaauaacauccuccgcacccaggaguccgagugcgccugugucaauggguuuugcuucacaguuaugaccgauggaccgagcaacggccaggcuucuuacaagauuuuuaaaaugaagaaagggaagguggugaaauccgucgaacugaacgcccccaauuaucacuacgaggaauguagcugcuauccugacgcuggagagaucaugugugugugcagagauaacuggcauggcucuaaucggcccuggguuagcuucaaccagaaucuugaguaccaaauuggcuauaucugcuccgggguguuuggagacaacccucgccccaaugauggcacggggucuuguggaccggucagcccuaacggcgccuacgggaucaagggauucuccuuuaaguacggcaauggcguguggauugggagaacaaaaagcaccaacucucgguccggauucgaaaugguuugggaccccaauggcuggacagauaccgacagcgacuucucuaucaagcaggauauuguggcgaucaccgacugguccggguauagcggauccuuuguccagcacccugagcugacaggccucgauugcauucgccccuguuucuggguggaacugaucagagggcggcccaaagagucuacgaucuggaccagcggcuccucuauuagcuuuugcggagucaacuccgaaacagugagcuggucuuggccugacggcgccgagcuuccguucaccaucgauaaguga

SEQ ID NO: 209384 - RNA, 1350 nt, Artificial Sequence; identical to SEQ ID NO: 209011
  derived and/or modified sequence opt5 from neuraminidase__InfluenzaA__EPI164142

SEQ ID NO: 209385 - RNA, 1350 nt, Artificial Sequence
  derived and/or modified sequence opt5 from neuraminidase__InfluenzaA__EPI827076
augaaccccaaucagaagaucgugaccauuggcagcaucugcauggucauugggaucauuucccugaugcuccaaaucggaaacaucauuucuaucuggguuagccacuccauucagacaggcaaucagcaucagacggagccuaucagaaacaccaauuuccugacagaaaacgccguggcuucugugacccuugccgggaauagcucccuguguccgauuaaaggaugggcgguccacucuaaggacaacagcauccggauuggcuccaaaggggauguguuuguuauccgcgagcccuucaucagcugcucucaucucgaauguagaacauuuuuccugacccaaggagcccuucugaaugacaagcacuccaacggcacagugaaagaucggagcccucaucgcacccucaugucuugccccauuggcgaggcuccuucccccuacaauagcagauuugaaucugucgccugguccgcuagcgccugucacgacgggacguccuggcugaucauuggaaucucuggcccugauaacggggcuguggccguucugaaguauaauggaauuaucaccgacacaaucaagagcuggcggaacaauauucuccgcacccaggaguccgagugcgcgugugugaacggcagcugcuucgccgucaugacagaugggccgucuaacggacaggcuuccuacaaaaucuuuaagauugaaaaaggcaagguggugaaaagcgucgagcugaaugcccccaacuaucacuacgaagaguguucuugcuauccugacgcuggcgagaucauuuguguuugcagagauaauuggcaugggagcaaccggcccuggguguccuucaaucagaaccuugaauaccaaaucggauauaucugcucuggcguguuuggggacaauccucgccccaacgauggaaccggcagcugugggccggucuccagcaauggagccuacggcgugaagggcuucucuuuuaaguacgggaacggaguuuggauuggcagaacgaaauccacacacagccggucuggguucgagaugaucugggacccuaauggauggaccggcacagauuccgaauuuagcaugaagcaggacauuguggcgaucaccgacugguccggguauucuggcagcuucguccagcaucccgagcugaccggacucgauugcauucgcccuuguuucuggguggaacugaucagaggccggcccaaagaguccacaauuuggacgucugggagcuccaucagcuuuugcggaguuaacucugacaccguguccuggagcuggcccgauggcgccgagcuuccuuucacaaucgacaaguga

SEQ ID NO: 209386 - RNA, 1350 nt, Artificial Sequence; identical to SEQ ID NO: 199603
  derived and/or modified sequence opt5 from neuraminidase__InfluenzaA__EPI168491

SEQ ID NO: 209387 - RNA, 1350 nt, Artificial Sequence
  derived and/or modified sequence opt5 from neuraminidase__InfluenzaA__EPI827078
augaaccccaaucagaagaucauuaccaucggcagcauuugcauggugaucgggauugccucccugaugcuccaaaucggaaacaucauuucuaucuggauuagccacuccauccagacaggcaaucagugucagaacgagucuauuagcaauacgaaauuccuggcugaaaaggccgucgcguccguuacccuugcugggaacucuagccugugcccuguguccggaugggccguguacagcaaagacaauucuaucagaauuggcuccaagggggaugucuuugugauccgggagccguucaucagcuguucucaucucgaaugccgcacauuuuuccugacccaaggagcccuucugaacgacaaacacuccaauggcacaguuaaggauagaagcccccaucggacccucaugucuuguccugugggcgaggcucccuccccuuauaacagccgcuuugaauccgucgccuggucugcuagcgccugccacgacgggacauccuggcugaccauuggaaucagcggccccgauucuggggcgguggccguucugaaguacaauggaauuaucacggacaccauuaaauccuggagaaacaauaucaugcggacacaggagagcgagugugcuugcgugaacggcucuuguuucaccaucaugacagaugggccuagcuccggacaggccucuuauaagauuuuuaaaauggaaaagggcaaagucaucaagagcguggagcucgacgcuccgaauuaccauuaugaagagugcuccuguuaccccgaugccggcgagauuaccugcgugugccgcgacaacuggcacgggagcaacagaccuuggaucucuuucaaucagaaccuggaauaucaaauuggauacaucuguuccggcgucuuuggggauaauccccggccuaacgacggaacgggcagcugcgggcccguuuucccgaauggagcguacggcgugaagggcuuuucuuucaaauaugggaacggaguguggaucggccgcacaaaguccaccaauagcagauccggguuugagaugauuugggauccuaacggauggacaggcaccgacucuagcuucuccgucaaacaggacaucguggccauuaccgaauggucuggguacagcggcuccuucguucagcaccccgagcuuacaggacuggauuguauccggccuugcuuuuggguggaacucauucgcggcagacccaaggagagcacgaucuggaccucuggguccagcauuucuuucuguggagucaauggcgacacaguguccuggagcuggcccgauggggcugagcugccuuuuaccaucgacaaauga

SEQ ID NO: 209388 - RNA, 1350 nt, Artificial Sequence
  derived and/or modified sequence opt5 from neuraminidase__InfluenzaA__EPI594521
augaaccccaaucagaagaucauuaccaucggcagcauuugcguggggaucggaauugucucccugaugcuccaaaucggcaacaugguuucuaucugggugaaucacagcauucagacagagaaccagugucaggccgaauccaucucuaauacgaaauuccugaccgagaaggcuguggccccugucacacuuauggggaacagcucccugugcccgauuucuggaugggcggugcauagcaaagacaauuccaucagaauuggcagcaagggggauguuuuugugauccgggaacccuucauuucuuguucccaccucgagugccgcaccuuuuuccugacacaaggagcccuucugaacgacaaacauagcaauggcaccgucaaggauagaucuccucaccgggcucucauguccugucccgugggcgaagccccuagccccuacaacucucgcuuugaguccguugcuuggagcgccuccgcuugccaugacgggacaggauggcugaccaucggcaucucugggccugauaauggagccguggcgguccugaaguauaacggcauuaucacggacaccauuaaaagcuggagaaauaacauccuccggacacaggaguccgaaugugccugcgugaaugggagcuguuucaccgugaugacagauggaccgucuaacggccaggcuuccuacaagauuuuuaaacuggagaagggcaaagucguuaagagcguggaacuugacgcccccaacuaucacuacgaggagugcucuuguuauccugaugcuggggaaauuaccugcgugugccgcgacaauuggcacggaagcaacagacccugggucuccuucaaucagaaccuggaguaccaaaucggcuauaucuguucugggguguuuggagauaauccucggcccaacgacggcacggggagcugcggaccgguuuccccuaauggcgccuacggcgugaagggguucagcuuuaaauacggaaacggcgucuggaucgggcgcacaaagucuaccaauuccagaagcggauucgaaaugauuugggaucccaacggcuggacagagaccgacucuuccuuuagcgugaaacaggacaucguugcgauuaccgauugguccggguauucuggcagcuucgugcagcauccugaacucacaggacuggacuguauccggcccugcuucugggucgagcuuauccgcggcagacccaaggaguccacgauuuggaccucugggagcuccaucagcuuuuguggagucaauucugauacagugggcugguccuggccugacggggccgaagugccguucaccauugauaaauga

SEQ ID NO: 209389 - RNA, 1410 nt, Artificial Sequence
  derived and/or modified sequence opt5 from neuraminidase__InfluenzaA__EPI5787
augaaccccaaucagaagaucauuaccaucggcagcauuugcaugguggucgggaucauuucccugaugcuccaaaucggaaacaucauuucuaucuggguuagccacuccauucagacaggcaaucagcaucaggccgagccuuguaaccaaucuaucauuacguacgaaaauaacaccugggugaaucagacauaugugaacaucagcaauaccaacuuccugacagagaaagcugucgccuccgugacccuugcgggaaauucuagccugugcccgauuuccgggugggcuguucacagcaaggacaacggcaucagaaucgggucuaaaggagauguguuugucauucgggaacccuucaucuccuguagccaucucgagugccgcacauuuuuccugacccagggcgcccuucugaaugacaagcacucuaacggcacggugaaagauagauccccucaucggacccucaugagcugucccguuggggaagccccuucucccuacaauucccgcuuugagagcguggcuugguccgccucugcuugccacgacggaacaagcuggcugaccauuggcaucuccgggccugauaacggagccgucgcggugcugaaguauaacggcauuaucacagacaccaucaagagcuggagaaauaacauucuccggacgcaggagucugaaugugccugcgugaauggguccuguuucacagucaugaccgauggaccgagcaacggccaggcuucuuacaaaaucuuuaagauggagaaaggcaagguugugaaaagcguggaacugaaugcccccaacuaucacuacgaggagugcuccuguuauccugacgcuggggaaauuacaugcgucugccgcgauaauuggcauggaucuaacagacccugggugagcuucaaucaaaaccuugaguaccagaucggcuacauuuguuccgggguuuuuggagacaauccucggcccaacgauggcaccgggagcugcggaccggugucuccuaauggcgccuauggcgucaagggguucuccuuuaaguacggaaacggcguguggaucgggcgcaccaaaagcacaaauucuagauccggauucgaaaugaucugggaccccaacggcuggacggggaccgauagcuccuuuucuguuaagcaggacauuguggcgaucacagacuggagcggcuauuccggaucuuucguccaacacccugagcugaccggccucgauuguauucggcccugcuucuggguggaacugauccgcgggagacccaaagagagcacaauuuggaccuccggaagcucuaucuccuuuuguggcgucaacagcgacacggugggguggucuuggccugaugacgccgagcuuccguucacaauugauaaguga

SEQ ID NO: 209390 - RNA, 1410 nt, Artificial Sequence; identical to SEQ ID NO: 209389
  derived and/or modified sequence opt5 from neuraminidase__InfluenzaA__EPI5787

SEQ ID NO: 209391 - RNA, 1350 nt, Artificial Sequence; identical to SEQ ID NO: 204089
  derived and/or modified sequence opt5 from neuraminidase__InfluenzaA__EPI267031

SEQ ID NO: 209392 - RNA, 1350 nt, Artificial Sequence; identical to SEQ ID NO: 205669
  derived and/or modified sequence opt5 from neuraminidase__InfluenzaA__EPI376539

SEQ ID NO: 209393 - RNA, 1350 nt, Artificial Sequence
  derived and/or modified sequence opt5 from neuraminidase__InfluenzaA__EPI124069
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacaaggagcccuucugaaugacaagcacagcaacggcaccgugaaagaucggucuccucaucgcacacucauguccugccccgucggcgaggccccuagccccuacaauucuagauucgaauccguggcuuggagcgccuccgcuugucacgacgggaccucuuggcugacgaucggaauuagcggcccugauaacgaggccguugcggugcugaaguauaaugggaucauuaccgacacaaucaaguccuggcggaacaauauucuccgcacccaggagagcgaaugcgccugugucaacggaucuugcuuuacagugaugaccgauggcccguccgacgggcaggcuagcuacaaaaucuucaagauggagaaaggaaagguggucaaaucuguugaacuggaugcccccaacuaucacuacgaggaguguagcugcuauccugacgcuggcgaaaucacgugugugugcagagauaauuggcauggcuccaaccggcccugggugucuuuuaaucagaaccuugaguaccaaauuggguauaucugcagcggagucuucggcgacaauccucgccccaacgaugggacaggauccuguggcccgaugagcccuaauggggccuacggagugaagggcuuuucuuucaaguacggcaacgggguuuggauuggaagaaccaaauccacaaauagccggucuggcuuugaaaugaucugggaccccaacggguggaccggaaccgacuccagcuucuccgugaagcaggauauugucgcgaucacagacuggucuggcuauagcggguccuuugugcagcacccugagcugacgggccucgauugcauccgccccuguuucuggguugaacugauuagaggacggcccaaagagucuaccaucuggacaagcggcuccagcauuucuuucugcggggucaauuccgacaccgugagcuggucuuggccugauggagccgagcuuccguuuacaaucgacaaguga

SEQ ID NO: 209394 - RNA, 1350 nt, Artificial Sequence
  derived and/or modified sequence opt5 from neuraminidase__InfluenzaA__EPI342499
augaaccccaaucagaagaucauuaccaucggcagcauuugcauggugaucgggauugucucccugaugcuccaaaucggaaacaugaucucuauuuggaucagccacuccauucagaaaggcaaucagcauagaacagagucuaucagcaacacgaauccucugaccgaaaaggccguugcuuccgugacacuuaccgggaacucuagccuguguccgauucggggaugggccgugcacuccaaagacaauaacauccgcauuggcagcaagggggaugucuucgugaucagagagcccuuuaucucuugcucccaucucgaaugucggacauucuuucugacccagggagcgcuucugaaugacaaacacagcaacggcacaguuaaggaucgcucuccucauagaacccucauguccugcccccugggcgaggcuccuagccccuacaauucucgguucgaauccguggccuggagcgccuccgcuugucacgacgggacgggauggcugaccauuggcaucucugggccugauaacgaggccgucgcugugcucaaguauaauggaauuaucacagacaccauuaaaagcuggcgcaacaauauccugagaacacaagaguccgaaugcgccuguguuaacggcagcugcuuuaccgugaugacggaugggccgucuaacggacaggcguccuacaagaucuucaaaaugcggaagggcaaagucgucaagagcguggagcuugacgcccccaauuaucacuacgaagaguguucuugcuauccugauacaggcgagauuaccugugugugccgcgacaacuggcaugggagcaauagacccuggaucuccuuuaaccagaaucuggaauaccagauuggauauaucugcucuggcauuuucggggauaacccucggcccaaugacggaacaggcagcugugggccgauguccccuaacggagcuuacggcguuaagggcuuuagcuucaaauacgggaauggaguguggaucggccgcaccaagucuaccaacuccagaagcggguuugagaugaucugggaucccaauggauggacagaaacggacucuuccuucagcgugaaacaagacauugucgccaucaccgauugguccggcuauucugggagcuuugugcagcacccugagcucacaggccuggacugcauucggcccuguuucuggguugaacuuauccgcggaagacccaaggaguccaccauuuggacaucuggcagcuccaucagcuucugcggggugaacucugauaccgucuccuggagcuggccugacggagcugagcugccguuuacgauugauaaauga

SEQ ID NO: 209395 - RNA, 1350 nt, Artificial Sequence
  derived and/or modified sequence opt5 from neuraminidase__InfluenzaA__EPI103069
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccaucaaagaucgcuccccucauagaacacucaugagcugccccgugggcgaggccccuucucccuauaauucccgguuugaaagcgucgcuugguccgccucugcuugucacgacgggaccagcuggcugacgauuggaaucuccggcccugauaacggggccguggcgguucugaaguacaauggaauuaucaccgacacaauuaagagcuggcgcaacaauauccucagaacccaggagucugagugcgccugugugaacggcuccugcuucacagucaugaccgaugggccgagcucuggacaggcuagcuauaaaaucuuuaagauggaaaaaggcaagguggugaaauccgucgagcuggacgcccccaauuaccauuaugaagaguguucuugcuacccugaugcuggcgagauuacguguguuugccgggacaacuggcacgggagcaaccgccccuggguguccuucaaucagaaccuugaauaucaaaucggauacauuugcagcggcguguuuggggauaauccuagacccaacgacggaacaggcucuugugggccggucuccccuaauggagccuacggcgugaagggcuucagcuuuaaguaugggaacggaguuuggaucggccggaccaaaucuacaaauucccgcagcggguucgagaugauuugggaucccaacggauggaccggcaccgacuccucuuuuagcgugaagcaggacaucgucgcgaucacagauugguccggguacucuggcagcuucgugcagcacccugaacugacgggacucgacugcauuagacccuguuucuggguugagcugauccggggccgccccaaagaauccaccauuuggacaagcgggucuuccaucagcuuuugcggagucaauucugauaccguguccuggagcuggccugacggcgccgagcuuccguucacaauugauaaguga

SEQ ID NO: 209396 - RNA, 1350 nt, Artificial Sequence; identical to SEQ ID NO: 209372
  derived and/or modified sequence opt5 from neuraminidase__InfluenzaA__EPI227595

SEQ ID NO: 209397 - RNA, 1410 nt, Artificial Sequence
  derived and/or modified sequence opt5 from neuraminidase__InfluenzaA__EPI569385
augaaccccaaucagaagaucauuaccaucggcagcgugucccugacaauugccacggucugcuuccucaugcaaaucgcuauucuggccaccacaguuacccuucacuuuaaacagaacgaguguucuaucccuccgaauaaccagguggugcccugcgaaccuaucauuaucgagaagaauauuacagaaaucgucuaccugaacaauaccacaauugagaaagaagugugucccgagguuccugaguauagaaacuggagcaagccccagugccaaaucaccggguucgcgccuuuuuccaaagacaauucuauucggcucagcgcuggaggcgauaucugggugacgcgcgaaccguacgucuccuguucucccgggaagugcuaucaguucgcccugggacagggcaccacacuuaacaauaagcauagcaacgggaccauccacgaccggauuccucauagaacacugcucauguccgagcugggagugcccuuucaccugggcaccaaacagguuuguaucgccuggucuagcuccagcugccaugauggcaaggcuuggcuccacgugugugucacgggggacgaucgcaaugccacagcuucuuucauuuacgacggaaugcuggccgauuccaucggcagcuggucucaaaacauucuuagaacccaggaauccgagugcguguguaucaaugggacaugcaccguggucaugaccgacggaagcgcguccggccgggccgauacacgcauccuguuuauuaaagaggggaagaucguucacauuucuccucucagcggauccgcucagcauaucgaagagugcagcuguuaucccagauacccggacgugcggugcgugugucgcgauaacuggaaaggcucuaacagaccugucauugacaucaauauggccgauuauuccaucgacagcucuuacgugugcagcggccugguuggggacacgccccggaacgaugacuccucuagcuccagcaauugucgcgauccuaacaaugaaagaggaaaccccggcgugaaggggugggcuuucgacaauggaaacgaugucuggaugggccggaccauuucugaggacucccgcagcggguacgaaacauuuagagugaccgauggauggacaaccgccaauucuaagucccagguuaaccggcaaaucauuguggacaauaacaauuggagcggcuauuccggcaucuucucugucgaggggaaaagcugcauuaacagauguuuuuacguggagcuuauccgcggacggccccaggaaacgagagucugguggacauccaauucuauugugguuuucugcggcaccagcgggaccuauggaacaggcuccuggccugauggggcgaacaucaacuuuaugccgaucuga

SEQ ID NO: 209398 - RNA, 1380 nt, Artificial Sequence
  derived and/or modified sequence opt5 from neuraminidase__InfluenzaA__EPI736916
augaaccccaaucagaagauuaccugcaucagcgccacaggcgugacgcuguccgucguuucucuccugaucgggauugcuaaccuuggacugaauaucggccuccacuacaaagugagcgacuccaccacaauuucuaucccuaacaugaaugagaccaacccgacaaccacaaauaucaccaacauuaucgugaauaagaacgaagagagaacguuccugaaucuuaccaaaccccugugugaagucaacagcuggcauauucucuccaaggauaaugccauccggauuggggaggacgcgcacauccuggugacacgcgaaccuuaucugucuugcgauccccaaggauguagaauguuugcucucagccagggcaccacacugcgggggcgccaugccaacggaaccauucacgacagauccccuuuccgggcccuuaucagcugggagaugggccaggcucccucuccuuacaauacgcgcguugagugcaucggcugguccagcacaucuugucaugaugggauuuccagaaugagcaucugcauuucuggaccgaacaacaaugccuccgcuguggucugguaucggggccgccccgugaccgaaaucccuagcugggccgggaacauucugagaacacaggaguccgaauguguuugccacaaaggaaucugucccguggucaugaccgacggcccugcgaauaacaaggccgcuaccaagaucauuuacuuuaaagaggggaaggugcagaaaaucgaggaacuccaaggaaaugcccagcacauugaggaaugcucuuguuauggcgcugccggcaugaucaagugcgugugccgggauaacuggaaaggggcgaaucgccccauuaucacaaucgacccggagaugaugacgcauaccagcaaguaccuguguuccaagauucuuacagauaccagcagaccuaacgaccccacaaauggaaacugcgaugccccuaucaccggcgggucucccgaccccggagucaaaggcuucgcuuuucuggauggggaaaauuccuggcucggacggacgauuagcaaggacucucgcagcggcuaugagaugcugaaaguuccuaacgccgagacagacacccaguccggcccgaccucuuaccaacugaucgugaauaaccagaauuggagcggguacuccggagcuuucauugauuauugggccaacaaggaauguuuuaaccccugcuucuacguggagcucaucagaggccggccuaaagaaagcgacguccuguggacaucuaauuccaugguggcccuuugugggagcagagagcgccugggaucuugguccuggcacgauggcgcugaaauuaucuauuuuaaguga

SEQ ID NO: 209399 - RNA, 1380 nt, Artificial Sequence; identical to SEQ ID NO: 209018
  derived and/or modified sequence opt5 from neuraminidase__InfluenzaA__EPI593891

SEQ ID NO: 209400 - RNA, 1380 nt, Artificial Sequence
  derived and/or modified sequence opt5 from neuraminidase__InfluenzaA__EPI691380
augaaccccaaucagaagaucgugugcauuagcgucaccggcguuacacuguccguggugucucuccugaucgggauuacgaaccuuggacugaauaucggccuccacuacaaagucagcgacuccaccacaauuaacaucccuaauaugaacgagaccaauccgacaaccacaaacaucaccaauauuaucaugaacaagaaugaagagagaacguuccugaaacuuaccaagccccugugugaagugaacucuuggcauauucucagcaaagauaaugccauccggauuggggaggacgcucacauccugguuacacgcgaaccuuaucuguccugcgauccccaaggauguagaauguuugcccucucucagggcaccacacugcgggggcagcaugcgaacggaaccauucacgaccgcagcccuuucagagcucuuaucuccugggagaugggccaggcccccagcccuuacaauacgcggguggagugcaucggcuggucuuccacaagcugucaugaugggauuucucgcauguccaucugcauuagcggaccgaacaacaaugccucugcugucgugugguauagaggccggcccguuaccgaaaucccuuccugggccgggaacauucugcgcacacaagagagcgaaugugugugccacaagggaaucugucccgucgugaugaccgacggcccugcuaauaacaaggccgcgaccaaaaucauuuacuuuaaggaggggaaaauccagaagacagaggaacuccagggaaaugcccagcacauugaggaaugcuccuguuauggcgcugccggcaugaucaaaugcgugugcagagauaacuggaagggggcuaaucggcccauuaucacgaucgacccggagaugaugacccauacaucuaaguaccuguguagcaaaauucuuaccgauacaucccgcccuaacgaccccaccaauggaaacugcgaugccccuaucacgggcgggagccccgaccccggagucaagggcuucgcguuucuggauggggaaaauucuuggcucggaagaacaauuuccaaagacagccggucuggcuaugagaugcugaagguuccuaacgccgagaucgacauucaaagcggcccgaucuccuaccagcugguggugaauaaccagaauuggucuggguacagcggagcuuucauugauuauugggccaacaaagaauguuuuaaccccugcuucuacgucgagcucauccgcggcagaccuaaggaauccggggugcuguggaccagcaauucuaugguugcucuuuguggaucccgggagagacugggcagcuggucuuggcacgacggggccgaaaucauuuauuuuaaauga

SEQ ID NO: 209401 - RNA, 1413 nt, Artificial Sequence
  derived and/or modified sequence opt5 from neuraminidase__InfluenzaA__EPI533584
augaaccccaaucagaagauuaccugcaucagcgccacaggcaugacgcuguccguggucucuaugcucaucgggauugcuaaccugggacuuaauaucggccugcacuacaaaguuagcgacuccaccaacauuaauaucccuaacaugaaugagacaucuccgaccacaaccaucauuaacaaucauccccaaaacaauuucacaaacaucaccaauauuaucgugacgaagaacgaagaggggcaccuccugaaucuuaccaaaccucugugugaagugaacagcuggcauauucucuccaaggauaacgccaucagaauuggagaggacgcgcacaucaucgucacacgggaacccuaucugucuugcgauccucagggcugucgcauguuugcucugagccaggggaccacacucagaggaaaacaugccaauggcaccauucacgaccggucccccuuccgcgcccuggugagcugggagaugggccaggcuccuucuccguacaacacgagaguugagugcaucgggugguccagcacaucuugucacgauggaauuucccggaugagcaucugcauuucuggccccaauaacaaugccuccgcuguggucugguaugggggacgcccugugaccgaaauccccagcugggccggcaacauccuuagaacacaagaguccgaauguguuugccaugggggaauuuguccuguggucaugaccgacggccccgcgaauaaccgggccgagaccaagaucauuuacuuuaaggagggcaaaaucaagaaaauugaggaacugaagggggaugcucagcacaucgaagagugcucuuguuauggagccagcgaaaugaucaaaugcauuugccgcgacaauuggaagggcgcuaacagaccggugaucacaauugauccugagaugaugacgcauaccuccaaguaccucuguagcaaaauccugacagacaccucucggcccaaugauccuacaaacgggaagugcgaggcccccauuaccggaggcucccccgacccuggggugaaaggauucgcguuucuugauggcgaaaauagcuggcugggccgcacgaucucuaaggacagcagauccggguaugagaugcucaaagucccgaacgccgaaacagacacccagucuggagcuauuagccaccagaucaucguuaauaaccaaaacugguccggcuacagcggggccuucauugauuacugggcuaauaaggaguguuuuaaccccugcuucuauguggaacugauccggggacgcccuaaagagucuuccgugcuguggaccagcaauucuauugucgcccucuguggcuccaaggagagacuggggagcugguccuggcacgacggcgccgaaaucauuuacuuuaaguga

SEQ ID NO: 209402 - RNA, 1380 nt, Artificial Sequence; identical to SEQ ID NO: 209022
  derived and/or modified sequence opt5 from neuraminidase__InfluenzaA__EPI641400

SEQ ID NO: 209403 - RNA, 1380 nt, Artificial Sequence; identical to SEQ ID NO: 209022
  derived and/or modified sequence opt5 from neuraminidase__InfluenzaA__EPI587620

SEQ ID NO: 209404 - RNA, 1410 nt, Artificial Sequence
  derived and/or modified sequence opt5 from neuraminidase__InfluenzaA__EPI569392
augaaccccaaucagaagaucgugaccauuggcagccugucccucgggcuggucguuuucaacgugcuucugcacgccgugucuaucauucucacaguccuggcucuuggaaaaagcgagaauaacggcaucugcaaugggacggugguuagagaauacaacgagaccgugcggauugaaaaggucacacaaugguauaauaccuccgugguugaguacgugccucauuggaacgaaggaacauauaucaauaacaccgagccgaucugugacgucaaaggcuuugcccccuucucuaaggauaaugggauucgcgugggaagcagaggccacaucuuugugauucgggagccuuucgucuccugcucucccguuggcugucgcacauuuuuccugacccaggggagccuccugaacgacaaacauuccaauggaacggugaaggauagaagcccuuuucggacccugaugucuguggaagucggccagucccccaacguguaccaggcgcgcuucgaggcuguugccuggagcgccacagcuugccacgacgggaagaaauggauggccaucggagugaccggcccugauucuaaggcugucgccgugguucauuaugggggagugccgacagacgucgucaauuccugggcgggcgauauucucagaacccaagaaagcucuuguacgugcauccagggcaacuguuacugggugaugacagacgggcccgccaaccggcaggcucaguaucgcauuuacaaagccaaucaaggaaagaucaucggcagaaaagauguguccuuuagcgggggacacauugaggagugcuccuguuacccuaacgacggcaagguugaaugcgugugucgggauaauuggaccgggacaaaccgccccguccugaucauuucuccugaccuuagcuauagagugggauaccugugcgcuggccuccccuccgauaccccgcggggcgaggacacccaguucguugggagcugcacaucuccuaugggaaaucagggcuauggggugaagggauuuggcuuccgccaggggacggacgucugggugggcagaaccaucucccggacaagcagaucuggauuugaaauuauccgcaucaaaaacggcuggacccaaacaagcaaggagcagauucggagacaggugguugucgauaauuccaacuggucuggguacagcggauccuucacccugcccguggaacuuagcggccgcgagugucuggugccuugcuucugggucgagaugauccgggggagacccgaggaacgcacgauuuggacaucuuccagcucuaucgugauguguggaguugacuaugaaauugccgauugguccuggcacgacggcgcgauccuccccuuugauaucgacaaauga

SEQ ID NO: 209405 - RNA, 1368 nt, Artificial Sequence
  derived and/or modified sequence opt5 from neuraminidase__InfluenzaA__EPI459857
augaaccccaaucagaagaucauuaccaucggcagcauuugcauggugaucgggacagucucccugauuguucaagugggaaacaucauccucauuugggugaaucacucuauccagacguguauuaccuacgagaacaauacaugggucaaccagaccuaugugagcaauacaaacuuccugaccggccaggccguugcuuccgugacacuugccggaaauucuagccugugcccuaucuccgggugggcgauuuacucuaaagacaacggcaucagaauugggagcaagggagaugucuuugugauccgggaaccguucaucuccuguagccaucucgagugccgcaccuuuuuccugacgcaaggcgcccuucugaaugacaaacacucuaacggcaccauuaaggauagaucccccuaucggacacucaugagcuguccuguuggggaagcucccucuccuuacaauucccgcuuugagagcguggccuggucugcuuccgccugccaugacggaaucaacuggcugaccauuggcaucagcgggcccgauaaugaagcugucgccgugcugaaauauaacggagugauuacagacaccaucaaguccuggagaaacaauauccuccggacgcaggagucugagugugcgugcgucaacggcagcuguuucacaguuaugaccgaugggccuuccaauggacaggccagcuacaagauuuuuaaaaucgaaaagggcaaaguggugcgcucugucgagcuggacgcuccgaacuaucacuacgaagagugcuccuguuaccccgaugccggcgagauuacaugcgugugcagagacaauuggcaugggagcaaccggccuuggguuucuuucaaucagaaccuugaauaucaaaccggauacaucuguagcggcguguuuggggauucuccccgcccuaaugacggaaccggcuccugcgggcccgucagcuccaacggagcuuucggcgugaagggcuuuagcuucaaauaugggaauggaguuuggauuggcagaacaaagacgaccaacucucgguccggguuugagaugaucugggauccgaauggauggacagaaaccgacagcucuuucuccaugaagcaggacaucauugccaucacagauuggagcggcuacuccgggucuuucgugcagcacccugagcugaccggccucaacuguaugcgccccugcuuuugggucgaacugauuagaggacagccucgggagaauacgaucuggacaagcggcuccucuauuagcuucuguggggugaacuccgagaccgucggauggagcuggcccgacggcgcggaacuucccuuuaccaucgauaaauga

SEQ ID NO: 209406 - RNA, 1416 nt, Artificial Sequence
  derived and/or modified sequence opt5 from neuraminidase__InfluenzaA__EPI242204
augaaccccaaucagaagcuguucgcccucagcggcguggcuaucgcccuguccguccuuaaccugcucauugggaucucuaauguuggacugaacgugagccuucaccugaaaggcgagggggugaagcaagaaaauaaccugaccugcacaacgauuacccagaauaacacaaccgucguggagaauacauacguuaacaauaccacaaucauuaacaaaggaaccaaucucaaggcgccuaacuaucugcuccugaauaaaucccuuuguucuguggaaggcugggucgugaucgcuaaggacaacgccaucagauuuggggagagcgaacagauuaucguuacgcgggagccguacguguccugcgaucccucuggauguaagauguaugcccugcaucagggcaccacaauucgcaacaaacacagcaauggcaccauccaugacagaacaaccuuccgggggcucauuuccacgccucugggaacacccccuaccgucagcaacucugauuuuaucugcgugggcugguccagcacaucuugucacgacggggugggacgcaugaccauuugcauccaaggcaauaacgauaaugcuaccgccacagucuacuauaacagacggcuuacgaccacaaucaagaccugggcuaaaaauauucugcgcacacaggaguccgaauguguuugccauaacgggaccugugccguggugaugacggacggacccgcgagcucucaggccuacacaaagaucauguauuuccacaaaggccucauuaucaaggaggaaccucugagaggcuccgcucggcacauugaggagugcagcuguuacgggcaugaucagaaggucuccugcgugugccgcgacaauuggcaaggagccaacagaccgaucaucgaaauugauaugucuacccuggagcacaccagccgguacguuuguacaggcgugcucaccgacacaucccgccccggggauaaaccuaauggagacugcagcaaccccaucacgggcucuccuggggcucccggagucaagggcuuuggcuuccugaauggggauaacaccuggcuuggaagaacaauuuccccgcggagccgcucuggcuuugaaaugcugaaaaucccuaaugccgagaccgaccccaacagcagaauuaucgaacggcaggagaucguggacaacuccaauuggucuggguauagcggauccuucauugauuacugggacgaggcgaacgaauguuauaauccuugcuuuuacguugagcucaucagaggccgccccgaagaggccaaguaugugugguggacaagcaacucucugauugcucuuugugggucccccgucagcgugggcucuggauccuucccugauggcgcccagauccaguacuuuagcuga

SEQ ID NO: 209407 - RNA, 1416 nt, Artificial Sequence
  derived and/or modified sequence opt5 from neuraminidase__InfluenzaA__EPI408029
augaaccccaaucagaagcuguucgcccucagcggcguggcuaucgcccuguccguccuuaaccugcucauugggaucucuaauguuggacugaacaugagccuucaccugaaaggcgagggggugaagcaagaaaauaaccugaccugcacaacgauuacccagaauaacacaaccguggucgagaauacauacgugaacaauaccacaaucauuaacaaaggaaccaaucucaaggcgccuaacuaucugcuccugaauaaaucccuuuguucuguugaaggcuggguggucaucgcuaaggacaacgccaucagauuuggggagagcgaacagauuaucgugacgcgggagccguacguuuccugcgaucccucuggauguaagauguaugcccugcaucagggcaccacaauucgcaacaaacacagcaauggcaccauccaugacagaacaaccuuccgggggcuccuguccacgccucuuggaacacccccuaccgugagcaacucugauuuuauuugcgucggcugguccagcacaucuugucacgacggggugggacgcaugaccaucugcauucaaggcaauaacgauaaugcuaccgccacaguguacuauaacagacggcugacgaccacaaucaagaccugggcuaaaaauauccuccgcacacaggaguccgaaugugucugccauaacgggaccugugccguugugaugacggacggacccgcgagcucucaggccuacacaaagauuauguauuuccacaaaggccugaucauuaaggaggaaccucugagaggcuccgcucggcacaucgaggagugcagcuguuacgggcaugaucagaagguguccugcgucugccgcgacaauuggcaaggagccaacagaccgauuaucgaaaucgauaugucuacccucgagcacaccagccgguacguguguacaggcguucugaccgacacaucccgccccggggauaaaccuaauggagacugcagcaaccccauuacgggcucuccuggggcucccggagugaagggcuuuggcuuccuuaauggggauaacaccuggcugggaagaacaaucuccccgcggagccgcucuggcuuugaaaugcucaaaauuccuaaugccgagaccgaccccaacagcagaaucauugaacggcaggagaucgucgacaacuccaauagaucuggguauagcggauccuucaucgauuacugggacgaggcgaacgaauguuauaauccuugcuuuuacguggagcugauucgcggccggcccgaagaggccaaguauguuugguggacaagcaacucucuuaucgcucugugugggucccccgugagcgucggcucuggauccuucccugauggcgcccagauucaguacuuuagcuga

SEQ ID NO: 209408 - RNA, 1398 nt, Artificial Sequence; identical to SEQ ID NO: 206478
  derived and/or modified sequence opt5 from neuraminidase__InfluenzaA__EPI439509

SEQ ID NO: 209409 - RNA, 1350 nt, Artificial Sequence; identical to SEQ ID NO: 209011
  derived and/or modified sequence opt5 from neuraminidase__InfluenzaA__EPI164223

SEQ ID NO: 209410 - RNA, 1398 nt, Artificial Sequence; identical to SEQ ID NO: 206478
  derived and/or modified sequence opt5 from neuraminidase__InfluenzaA__EPI486493

SEQ ID NO: 209411 - RNA, 1398 nt, Artificial Sequence
  derived and/or modified sequence opt5 from neuraminidase__InfluenzaA__EPI740737
augaaccccaaucagaagauccugugcaccagcgccacagcuauuacgaucuccgccauugcggugcucaucggcauugcuaaccuggggcuuaauaucggacugcaccucaaaccuggcuguaacugcucucauagccaaccggagaccacaaauaccucccagacaaucauuaacaauuacuauaacgaaaccaauaucacaaacauucagaucgaggaaagaaccucucggaauuucaacaaucugacgaaggggcuuuguaccauuaacagcuggcacaucuacggaaaagacaaugccguccgcauuggcgaguccucugauguucuggugacaagagaacccuaugugagcugcgacccugaugagugucgguuuuacgcccucucccaggggaccacaauccgcggaaagcauagcaacggcaccauccacgacagaucucaauaucgggcucugauuuccuggccccugagcucuccucccacgguccauaacucccgcguggagugcaucggcuggagcucuacauccugucacgaugggaaaagcagaauguccauuugcaucucuggaccuaauaacaaugccagcgcuguugugugguacaaccggcgcccggucgccgaaauuaauaccugggcgagaaacauccuccggacacaggaguccgaaugugugugccacaauggcguuugucccguggucuucaccgacgggccugccaccggacccgcugauacacgcaucuauuacuuuaaggagggcaagauucugaaaugggagagccuuacggggaccgccaagcauaucgaagagugcucuugcuacggagaaagaacaggcauuaccuguacaugccgggacaacuggcagggcuccaaucgcccuguggugcagaucgaucccgucgcuaugacccacacgagccaauauauuuguucuccgguucugacagacagcccuagacccaacgauccuaauaucgggaaaugcaacgaccccuaccccggaaauaacaauaacggcgugaagggguucuccuaucucgauggagccaacaccuggcugggccggaccaucucuacagcgagcagauccggguacgagaugcuuaaagugccuaaugcccugaccgacgaccgcagcaagccgauucagggacagacaaucguccucaacgcugauuggucuggcuauuccggcagcuuuauggacuacugggccgaaggggauuguuaucgggcuugcuucuacguggagcugauuagaggacgccccaaggaggacaaaguuugguggacgucuaauuccaucgugagcauguguuccucuaccgaauuucugggccaguggaacuggccugauggggccaagauugaguacuuccucuga

SEQ ID NO: 209412 - RNA, 1398 nt, Artificial Sequence
  derived and/or modified sequence opt5 from neuraminidase__InfluenzaA__EPI730494
augaaccccaaucagaagauccugugcaccagcgccacagcuauuacgaucggcgccauugcggugcucaucgggauugcuaaccugggacuuaauaucggccugcaccucaaaccuggguguaacugcucccauucucaaccggagaucaccaauacaagccagaccauuaucaacaauuacuauuccgaaacaaacauuaccaauauccagauggaggaaagaacaucuaagaacuucaauaaccugaccaaaggacuuuguacgauuaauagcuggcacaucuacggcaaggacaacgccguccggauuggggaguccucugauguucuggugacccgcgaacccuaugugagcugcgacccugaugaguguagauuuuacgcccucucccagggaacaaccauccggggcaaacauagcaauggcacaauccacgaccgcucucaauauagagcucugauuuccuggccccugagcucuccucccaccgucuacaacucccggguggagugcaucggguggagcucuacguccugucaugauggaaagagccgcauguccauuugcaucucuggcccuaacaauaacgccagcgcuguugugugguauaauagacggccggucgccgaaauuaacacaugggcgcgcaauauccucagaacccaggaguccgaaugugugugccacaacgggguuugucccguggucuucacagacggaagcgccaccggcccugcugauacccggaucuacuacuuuaaggaggggaaaauucugaagugggagucucuuacaggaacggccaaacacaucgaagagugcuccugcuauggcgaacgcaccggcauuacauguaccugcagagacaauuggcaggggagcaaccggcccgugauccagauugauccuguggcuaugacacauaccucucaauacaucuguagccccguccugacggacaauccgcgcccuaacgaucccaauaucggaaagugcaacgacccuuaucccggcaauaacaauaacgggauuaaaggauucuccuaccucgauggcgccaacacauggcuggggagaaccaucucuaccgcgagccgguccggauaugagaugcuuaagguucccaaugcccugacagacgacagaagcaagccuauucagggccagaccaucgugcucaacgcugauuggucuggcuacuccgggagcuuuauggacuauugggccgaaggagauuguuaccgcgcuugcuucuacguggagcugauucggggcagaccgaaagaggacaaggucugguggacaucuaauuccaucgugagcauguguuccucuacggaauuucuggggcaguggaacuggcccgauggagccaaaauugaguauuuccucuga

SEQ ID NO: 209413 - RNA, 1398 nt, Artificial Sequence
  derived and/or modified sequence opt5 from neuraminidase__InfluenzaA__EPI712925
augaaccccaaucagaagauccugugcaccagcgccacagcuauuacgaucggcgccauugcggugcucaucgggauugcuaaccugggacuuaauaucggccugcaccucaaaccuggguguaacugcucccauucucaaccggagaccacaaauaccagccagacaaucauuaacaauuacuauaacgaaaccaauaucacaaacauucagaucgaggaaagaaccucccggaauuucaacaaucugacgaagggacuuuguaccauuaacucuuggcacaucuacggcaaagacaaugccguccgcauuggggagagcuccgauguucuggugacaagagaacccuaugugucuugcgacccugaugagugucgguuuuacgcccucagccagggaaccacaauccgcggcaagcauuccaacggcaccauccacgacagaagccaauaucgggcucugauuucuuggccccuguccagcccucccacgguccauaacucucgcguggagugcaucgggugguccagcacaucuugucacgauggaaaauccagaaugagcauuugcaucuccggcccuaauaacaaugccucugcuguugugugguacaaccggcgcccggucgccgaaauuaauaccugggcgagaaacauccuccggacacaggagagcgaaugugugugccacaaugggguuugucccguggucuucaccgacggaccugccaccggccccgcugauacacgcaucuauuacuuuaaggaggggaagauucugaaaugggagucccuuacgggaaccgccaagcauaucgaagagugcagcugcuacggcgaaagaacaggcauuaccuguacaugccgggacaacuggcaggggucuaaucgcccuguggugcagaucgaucccgucgcuaugacccacacgucccaauauauuuguagcccgguucugacagacucuccuagacccaacgauccuaauaucggaaaaugcaacgaccccuaccccggcaauaacaauaacggggugaagggauucagcuaucucgauggcgccaacaccuggcuggggcggaccaucuccacagcgucuagaagcggauacgagaugcuuaaagugccuaaugcccugaccgacgaccgcuccaagccgauucagggccagacaaucguccucaacgcugauuggagcggcuauucuggguccuuuauggacuacugggccgaaggagauuguuaucgggcuugcuucuacguggagcugauuagaggccgccccaaggaggacaaaguuugguggacgagcaauucuaucguguccauguguagcuccaccgaauuucuggggcaguggaacuggccugauggagccaagauugaguacuuccucuga

SEQ ID NO: 209414 - RNA, 1398 nt, Artificial Sequence
  derived and/or modified sequence opt5 from neuraminidase__InfluenzaA__EPI448938
augaaccccaaucagaagauccugugcaccagcgccacagcuauuaucauuggcgccaucgcggugcucauugggauggcuaaccugggacuuaauaucggccugcaccucaaaccuggguguaacugcucccauucucaaccggagacgaccaauacaagccagaccaucauuaacaauuacuauaacgaaacaaauaucaccaacauucagauggaggaaagaacaucccggaauuucaacaaucugaccaagggacuuuguacgaucaacucuuggcacauuuacggcaaagacaaugccguccgcaucggggagagcuccgauguucuggugaccagagaacccuaugugucuugcgacccugaugagugucgguuuuacgcccucagccagggaacaaccauucgcggcaagcauuccaacggcacaauccacgacagaagccaauaucgggcucugaucucuuggccccuguccagcccucccaccgucuacaacucucgcguggagugcauugggugguccagcacgucuugucaugauggaaaauccagaaugagcaucugcauuuccggcccuaauaacaaugccucugcuguugugugguauaaccggcgcccggucgccgaaaucaauacaugggcgagaaacauucuccggacccaggagagcgaaugugugugccacaaugggguuugucccguggucuucacagacggauccgccaccggcccugcugauacccgcaucuacuacuuuaaggaggggaagauccugaaaugggagagccuuacaggaacggccaagcacauugaagagugcucuugcuauggcgaaagaaccggcaucacauguaccugccgggacaacuggcagggguccaaucgccccgugauucagaucgauccuguggcuaugacacauaccagccaauacauuuguucucccguccugacggacaacccgagaccuaaugaucccaacaucggaaaaugcaaugacccuuaucccggcaacaauaacaacgggguuaagggauucagcuaccucgauggcgccaauacauggcuggggcggaccaucuccaccgcgucuagaagcggauaugagaugcuuaaagugcccaacgcccugacagacgaccgcuccaagccuauucagggccagaccaucgugcucaaugcugauuggagcggcuacucuggguccuuuauggacuauugggccgaaggagauuguuaccgggcuugcuucuacgucgagcugauuagaggccgcccgaaggaggacaaagugugguggacaagcaacucuaucguuuccauguguagcuccacggaauuucuggggcaguggaauuggcccgauggagccaagauugaguauuuccucuga

SEQ ID NO: 209415 - RNA, 1410 nt, Artificial Sequence
  derived and/or modified sequence opt5 from neuraminidase__InfluenzaA__EPI445995
augaaccccaaucagaagaucauugcccugggcagcgcuucccucaccaucgccauuaucugccugcuuauucaaaucgcgauccuggcuacaacgaugacccuccacuucaugcagaacgagcauacaaauucuaccagaaacaaaguggucccuugugaaagcauuaucauugagcggaauaucacagaaauuguucaccugaacgggaccaucauugagaaggaauccugcccgaaagccguggaguacaagaauuggucuaaaccccagugucagaucacaggauuugccccuuucagcaaggacaacuccauccgccuuucugcuggcggggauauuugggugaccagagagcccuaugucagcugcucccugagcaaguguuaccaauuugcccucggacagggcacgacccugaauaaccggcauucuaaugggacaacccacgaccgcuccccuuauagaacacugcucaugagcgaacugggagugcccuuccaucuuggcaccaaacagguuugcaucgcuuggucuuccagcucuugucacgauggccgggccuggcugcacgugugcgucacgggggacgauaagaacgcgacagccuccgugauuuacggaggcaugcucaccgacagcaucggguccuggucuaaaaauauucugcgcacacaggagagcgaauguguuugcaucaacggaaccuguaccguggucaugacagauggcuccgcuagcgggagagccgacacgcggauccuuuuuauucgcgagggaaagaucgugcauauuucuccucuguccggcagcgcucaacacguggaggaaugcucuugcuauccgagauaccccgagguccgguguguuugccgcgauaauuggaaaggcagcaacagaccugugcucuauaucaacguggccgacuacuccauugauucuagcuacgucuguuccgggcuggugggagacacaccccggaaugaagauucuagcuccagcucuaacugccgcgacccuaauaacgagagaggcgggcccggaguuaagggcugggcguucgacaauggggaugacguguggaugggacggaccaucaagaaagauuccagagccggcuaugaaaccuuucgcgucguggacggcuggacacuggcuaacagcaagucccagaccaaucggcagguuaucguggauucugacaacuggagcggguacuccggaauguucucugucgagggcaaaacguguauuaauagaugcuuuuauguggagcucauccgcgggcggccgcaggaaacaagagucugguggaccagcaacuccauuaucguguucuguggaaccagcggcacauacgggaccggcucuuggccugauggagccgacauuaauuuuauguccaucuga

SEQ ID NO: 209416 - RNA, 1410 nt, Artificial Sequence
  derived and/or modified sequence opt5 from neuraminidase__InfluenzaA__EPI470861
augaaccccaaucagaagaucauugccaucggcagcgugucccugaccauugcuacaaucugccuccugaugcaaauugccauccuugcgacgaccaugacacugcacuucaaacagaacgaguguaucaauucuagcaacaaucaggucguuccuugcgaaccgauuaucauugagagaaacaucaccgaaauugugcaucucaauuccacaacccuggagaaggaaaucugucccaaaguggcugacuaccggaacuggucuaagccucagugccaaauuacaggguuugcccccuucagcaaagauaauuccauccgccuuucugccggaggcgacaucugggucaccagagagccuuaugugagcugugggcugggaaagugcuaccaguuugcucucggccaggggacgacccuggagaacaagcacuccaauggaacagcccaugaucggacaccccaccgcacccugcucaugaacgaacugggcguuccuuuccaucuugcuaccaaacagguguguauugccuggucuagcuccagcugccacgacggcaaggcguggcugcacgucugugugacgggggaugacagaaaugccacagcuucuaucauuuaugauggaauccucguugacuccauuggcagcuggucuaaaaacauccugcggacccaagaguccgaaugcguguguaucaaugggacaugcgccgucgugaugaccgauggaagcgcuuccggccgcgccgacacccggauucuuuuuauccgggaggggaagauugcgcauaucucuccgcugagcggauccgcccagcacguggaggaaugcagcuguuacccccgcuauccugaggucagaugcguuugucgggauaacuggaaaggcucuaaccgccccgugcucuacauuaauauggcuaacuauuccaucgacagcucuuacgugugcagcggccuggucggggauacaccuagaaaugacgaccgguccucuagcuccaacugucgcgaucccaauaacgaaagaggagccccgggcgugaaggggugggcuuucgacaauggaaacgauaucuggaugggccggacgauuaagaaagacagcagaucuggguacgagaccuuucgcguuaucggaggcuggacaaccgccaauuccaagagccagauuaacagacaggugaucgucgauucugacaauuccagcggcuauuccgggauuuucucuguggaaggaaaaagcugcaucaacagauguuuuuacguugagcugauucgcggccggccuaaggagacaagagugugguggaccuccaauucuaucaucgucuucugcgggacgagcggaacauauggcaccggguccuggcccgauggcgccaacauuaauuuuaugccuaucuga

SEQ ID NO: 209417 - RNA, 1401 nt, Artificial Sequence
  derived and/or modified sequence opt5 from neuraminidase__InfluenzaA__EPI498036
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauucucgagcggaacacaguucaucuuaauuccaccaucauugaacgcgagaucuguccuaaaguggcggacuacaagaacuggucuaaaccccagugccaaauuacaggguuugcuccuuucagcaaggauaauuccaucagacugucugccggaggcgacaucugggugacccgggaacccuaugucagcuguucccuggauaaaugcuaccaguuugcccucgggcagggaacaacccugaagaacaagcacagcaauggcacgacccaugaccgcacaccucacagaacccugcucaugaacgagcugggggugccguuccaucuuggaacaaaacagguuuguauugcuuggucuuccagcucuugcuaugauggcaaggccuggcugcacaucugugugaccggcgacgauaaaaaugcuacggccuccauuaucuacgacgggaugcucgucgauagcauuggaucuugguccaagaacauccugcggacacaagagagcgaaugcguguguaucaaugggaccugcgcgguugugaugacagacggguccgccucuggaaaagcugauacccgcguccuuuuuauuagagagggcaagaucauuaacaucagcccccuguccgggagcgcccagcacguggaagagugcucuuguuauccucgguaccccgaggugcgcugcgucuguagagacaacuggaagggauccaaucggccuauucucuauaucaacauggcugauuacagcaucgaaucuagcuacguuugcuccggccuggugggcgacacaccccgcaaugacgauucuagcuccagcucuaacuguagagacccgaauaacgagcggggcgccccuggagugaaaggcugggcguucgaugacgggaaugaugucuggaugggacgcaccauuaagaacggcuccagaagcggguaugaaacguuucgggugguuaauggauggaccauggccaacucuaaaucccagaucaauagacaggugauugucgacagcgaugacugguccggcuacucuggcaucuucagcguggaggggaagaaaugcauuaaccgcuguuuuuauguugaacugauccggggaagaccccaagagccucgcgugugguggacauccaauucuauuaucgucuucugcggcaccagcgggacauacggaaccggcuccuggcccgauggggcuaacaucaauuuuaugcccguguga

SEQ ID NO: 209418 - RNA, 1410 nt, Artificial Sequence
  derived and/or modified sequence opt5 from neuraminidase__InfluenzaA__EPI470902
augaaccccaaucagaagaucguggccauuggcagcgcuucccugaccaucgccacaaugugccuccugaugcaaauugcgcuuuucgcuacgaccaugacacugcacuuuaaacagaccggguguacaaacucuagcgacaaucaggccgucccuugcggaccgaucauuaucgagagaaacaucaccgaaauuguucaucucaauuccacaacccuggagaaggaaacgugucccaaaucugccggcuaccggaacuggagcaagccucagugccaaaucaccggguucgcucccuuuuccaaagauaauucuauucgccuugccgcugccggagacaucugggugacaagagagccuuaugugagcuguggccuggggaagugcuaccaguucgcgcucggacagggcaccacacuggauaacaagcacuccaauggcaccacgcaugaccggacaccccaccgcacccugcucaugaacgaacugggggucccuuuucaucuugccacaaaacagguguguauugcuuggucuagcuccagcugccacgauggaaaggccuggcugcacguuugugugaccggcgacgauaaaaaugcuaccgccucuaucauuuaugacgggauccucgucgauuccaucgcgagcuggucuaagaacauucugagaacacaagaguccgagugcguguguaucaauggaacgugcaccguugugaugacagacggcagcgccuccgggcgggcugauacccgcauucuuuucaucagagaaggaaaaauuguccauaucucuccgcugagcggcuccgcccagcacguggaggaaugcagcuguuacccccgguauccugaggugcgcugcgucuguagagacaacuggaagggcucuaaucggcccguucucuuuaucaacauggcugauuacuccauugacagcucuuaugugugcagcgggcuggugggagacacaccucgcaacgaugacagauccucuagcuccaauugucgggaucccaacaaugagcgcggcgccccgggggucaagggaugggccuucgacagcggcaacgauaucuggauggggagaaccauugaaaaagacucucgguccggauacgagacguuuagagugaucggcggcuggagcacagcuaauucuaagucccagauuaaccgccagguuaucguggaucgggacaauagcuccggguacucuggaaucuucagcgucgaaggcaaauccugcauuaacagauguuuuuauguggagcugauccgcgggcggccuaaggaaaauagaguuugguggaccucuaacagcauuaucguguucugcggaaccuccggcacauacgggaccggcagcuggcccgauggagcgaauauuaaccucaugccuaucuga

SEQ ID NO: 209419 - RNA, 1401 nt, Artificial Sequence
  derived and/or modified sequence opt5 from neuraminidase__InfluenzaA__EPI838241
augaaccccaaucagaagaucaccgccauuggcagcgugucccugaucauugcuaucauuugccuccugaugcaaaucgccauccuuacaacgaccaugacacugcacuucagacagaacgaguguucuaauagcuccaacaaucaggucaugccuugcgaaccgauuaucauugagcggaacaccguucaucucaauucuacaaccaucgaacgcgagauuugucccaaaguggcggaauacaagaacuggagcaaaccucagugccaaaucacaggguuugcucccuucuccaaggacaauucuauuagacugagcgccuccggagauaucugggugacccgggagccuuaugucagcuguucucuugacaaaugcuaccaguuugcccugggccaggggacgacccucaagaacaagcacuccaauggaacagcucaugaucgcacaccccacagaacccugcugaugaacgagcucggcgugccuuuccaucuggggaccaaacagguuuguaucgccuggagcagcuccagcugcuaugacggaaaggcuuggcuucacgugugugucacgggcgaugacaaaaaugccacagcgucuauuaucuacgauggcaugcugguggacuccauugggagcugguccaagaacauccuccggacccaagaaucugagugcguuuguauuaauggaacaugcgccguggucaugaccgauggcagcgcuuccgggaaagccgacacccgcgugcuguuuaucagagaaggaaagaucauuaacaucagcccgcuuucuggcuccgcucagcacguggaggagugcagcuguuauccccgguacccugaaguccgcugcguuuguagagauaacuggaaggggucuaaucggcccauucuguauaucaacauggccgacuacagcauugaguccucuuacgugugcagcggacucgugggcgauacaccucgcaaugacgacuccucuucuuccagcaacuguagagaucccaauaacgaacggggcgcgccgggggucaaaggaugggccuucgacgauggcaaugacguguggauggggcgcacgaucaagaacggaucuagauccggcuaugagaccuuucggguugugaauggguggacaauggcuaacagcaaaucccagaucaauagacaggucauuguggaaucugaugacuggagcggauacuccggcaucuucucuguugagggcaagaaaugcauuaaccgcuguuuuuauguggagcugauccgggggagaccucaagaaccccgcgucugguggaccagcaauuccauuaucguguucugcggaacaagcggcaccuacgggacgggaucuuggccugauggcgccaacauuaauuuuaugcccaucuga

SEQ ID NO: 209420 - RNA, 1401 nt, Artificial Sequence; identical to SEQ ID NO: 209419
  derived and/or modified sequence opt5 from neuraminidase__InfluenzaA__EPI680525

SEQ ID NO: 209421 - RNA, 1401 nt, Artificial Sequence; identical to SEQ ID NO: 209027
  derived and/or modified sequence opt5 from neuraminidase__InfluenzaA__EPI690481

SEQ ID NO: 209422 - RNA, 1755 nt, Artificial Sequence
  derived and/or modified sequence opt5 from hemagglutinin__InfluenzaB__ABL76276
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacgcuacaagcagaucuggcuucuuugccaccauggcgugggccgucccccgggacaauaacaaaaccgcuacaaauccucuuacgguggaggugccccacaucuguaccaaggaagaggaucagauuacagucuggggguuccauuccgacaacaaaacccagaugaagaaucuguacggagauagcaacccgcaaaaguuuacaucuuccgccaauggcguuaccacgcacuaugugagccagaucgggggauucccugaccagacagaggauggcggccucccccagucugggcgcauuguggucgacuacauggugcaaaaaccuggaaagaccggcaccaucguuuaucagagagggauccugcuuccccagaaaguguggugcgcuuccggacggagcaaggucauuaaaggcucccugccccucaucggggaagccgauugucugcacgagaaguacggaggccugaacaaaucuaagccuuauuacacaggcgaacaugcgaaggccauugggaacugcccgaucugggugaaaacaccccucaagcuggcuaauggaacaaaauaccgcccucccgccaaacuucugaaggagagaggcuuuuucggggcuauugccggauuucucgagggcgggugggaaggcaugaucgccggauggcacggcuauacgagccauggggcucacggaguugcgguggccgcugaccugaaguccacccaggaggccaucaacaagauuaccaaaaaucuuaacagccugucugaacucgaggucaagaaucugcaacggcuguccggcgccauggaugaacuccacaacgagauccuggagcuugacgaaaaaguggacgaucugcgcgcugacaccauuagcucucagaucgagcucgccguccugcuuagcaaugaagggauuaucaacuccgaggaugaacaucugcucgcgcuggagagaaagcugaaaaagaugcucggaccuucugcuguggacaucggcaauggguguuucgagacaaagcacaaaugcaaccagaccugccuggaucggauugccgccggcacguuuaaugcuggagaguucagccuucccaccuuugacucccugaacaucacagccgcuagccucaaugaugacggccuggauaaccauaccauucugcuuuacuauucuacagccgcguccagccucgccguuacccugaugaucgcuauuuucaucguguacaugauuucuagagacaaugucuccuguagcaucugccuguga

SEQ ID NO: 209423 - RNA, 1755 nt, Artificial Sequence
  derived and/or modified sequence opt5 from hemagglutinin__InfluenzaB__ABL76287
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgauugaggugccccacaucuguaccaaggaagaggaucagauuacagucuggggguuccauuccgacaacaaaauccagaugaagaaucuguacggagauagcaacccgcaaaaguuuaccucuuccgccaauggcguuacaacccacuaugugagccagauugggggauucccugaccagacggaggauggcggccucccccagucugggcgcaucguggucgacuacauggugcaaaaaccuggaaagacaggcaccaucguuuaucagagagggauucugcuuccccagaaaguguggugcgcuuccggacggagcaaggucaucaaaggcucccugccccucauuggggaagccgauugucugcacgagaaguacggaggccugaacaaaucuaagccuuauuacaccggcgaacaugcgaaggccaucgggaacugcccgauuugggugaaaacaccccucaagcuggcuaauggaaccaaauaccgcccucccgccaaacuucugaaggagagaggcuuuuucggggcuaucgccggauuucucgagggcgggugggaaggcaugaucgccggauggcacggcuauacaagccauggggcucacggaguugcgguggccgcugaccugaaguccacgcaggaggccauuaacaagaucaccaaaaaucuuaacagccugucugaacucgaggucaagaaucugcaacggcuguccggcgccauggaugaacuccacaacgagauucuggagcuugacgaaaaaguggacgaucugcgcgcugacacaaucagcucucagauugagcucgccguccugcuuagcaaugaagggaucaucaacuccgaggaugaacaucugcucgcgcuggagagaaagcugaaaaagaugcucggaccuucugcuguggacauuggcaauggguguuucgagaccaagcacaaaugcaaccagacaugccuggaucggaucgccgccggcaccuuuaaugcuggagaguucagccuucccacguuugacucccugaacauuaccgccgcuagccucaaugaugacggccuggauaaccauacaauccugcuuuacuauucuaccgccgcguccagccucgccguuacacugaugauugcuaucuucauuguguacaugaucucuagagacaaugucuccuguagcaucugccuguga

SEQ ID NO: 209424 - RNA, 1755 nt, Artificial Sequence
  derived and/or modified sequence opt5 from hemagglutinin__InfluenzaB__ABL76298
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgguggaggucccccacauuuguaccaaggaagaggaucagaucacaguuuggggguuccauuccgacaacaaaacccagaugaagaaucuguacggagauagcaacccgcaaaaguuuacaucuuccgccaauggcgugaccacgcacuaugugagccagauugggggauucccugaccagacagaggauggcggccucccccagucugggcgcaucgucguggacuacaugguucaaaaaccuggaaagaccggcaccauuguguaucagagagggauccugcuuccccagaaagucuggugcgcuuccggacggagcaaggugaucaaaggcucccugccccucauuggggaagccgauugucugcacgagaaguacggaggccugaacaaaucuaagccuuauuacacaggcgaacaugcgaaggccaucgggaacugcccgauuuggguuaaaacaccccucaagcuggcuaauggaacaaaauaccgcccucccgccaaacuucugaaggagagaggcuuuuucggggcuaucgccggauuucucgagggcgggugggaaggcaugauugccggauggcacggcuauacgagccauggggcucacggaguggcggucgccgcugaccugaaguccacccaggaggccaucaacaagaucaccaaaaaucuuaacagccugucugaacucgaggugaagaaucugcaacggcuguccggcgccauggaugaacuccacaacgagauucuggagcuugacgaaaaagucgacgaucugcgcgcugacaccaucagcucucagauugagcucgccgugcugcuuagcaaugaagggaucauuaacuccgaggaugaacaucugcucgcgcuggagagaaagcugaaaaagaugcucggaccuucugcuguugacaucggcaauggguguuucgagacaaagcacaaaugcaaccagaccugccuggaucggaucgccgccggcacguuuaaugcuggagaguucagccuucccaccuuugacucccugaacauuacagccgcuagccucaaugaugacggccuggauaaccauaccauccugcuuuacuauucuacagccgcguccagccucgccgugacccugaugauugcuaucuucauugucuacauggugucuagagacaauguuuccuguagcaucugccuguga

SEQ ID NO: 209425 - RNA, 1755 nt, Artificial Sequence
  derived and/or modified sequence opt5 from hemagglutinin__InfluenzaB__ABL76309
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgguggaggucccccacauuuguaccaaggaagaggaucagaucacaguuuggggguuccauuccgacaacaaaacccagaugaagaaucuguacggagauagcaacccgcaaaaguuuacaucuuccgccaauggcgugaccacgcacuaugugagccagauugggggauucccugaccagacagaggauggcggccucccccagucugggcgcaucgucguggacuacaugguucaaagaccuggaaaaaccggcaccauuguguaucagcgggggauccugcuuccccagaaggucuggugcgcuuccggacgcagcaaagugaucaagggcucccugccccucauuggggaagccgauugucugcacgagaaauacggaggccugaacaagucuaaaccuuauuacacaggcgaacaugcgaaggccaucgggaacugcccgauuuggguuaagacaccccucaaacuggcuaauggaaccaaguacagaccucccgccaaacuucugaaggagcggggcuuuuucggggcuaucgccggauuucucgagggcgggugggaaggcaugauugccggauggcacggcuauacgagccauggggcucacggaguggcggucgccgcugaccugaaauccacccaggaggccaucaacaagaucacaaagaaucuuaacagccugucugaacucgaggugaaaaaucugcaacgccuguccggcgccauggaugaacuccacaacgagauucuggagcuugacgaaaaggucgacgaucugagagcugacaccaucagcucucagauugagcucgccgugcugcuuagcaaugaagggaucauuaacuccgaggaugaacaucugcucgcgcuggagcggaaacugaagaaaaugcucggaccuucugcuguugacaucggcaauggguguuucgagacaaagcacaagugcaaccagaccugccuggauagaaucgccgccggcacguuuaaugcugaagaguucagccuucccaccuuugacucccugaacauuacagccgcuagccucaaugaugacggacuggauaaccauaccauccugcuuuacuauucuacagccgcguccagccucgccgugacccugaugauugcuaucuucauugucuacaugaucucucgcgacaauguguccuguagcauuugccuguga

SEQ ID NO: 209426 - RNA, 1755 nt, Artificial Sequence
  derived and/or modified sequence opt5 from hemagglutinin__InfluenzaB__ABL76331
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacgcuacaagcagaucuggcuucuuugccaccauggcgugggccgucccccgggacaauaacaaaaccgcuacaaauccucuuacgaucgaggugccccacauuuguaccaaggaagaggaucagaucacaguguggggguuccauuccgacaacaaaacccagaugaagaaucuguacggagauagcaacccgcaaaaguuuacaucuuccgccaauggcgucaccacgcacuauguuagccagauugggggauucccugaccagacagaggauggcggccucccccagucugggcgcaucgugguggacuacaugguccaaaaaccuggaaagaccggcaccaucguguaucagagagggauucugcuuccccagaaaguuuggugcgcuuccggacggagcaaggugaucaaaggcucccugccccucauuggggaagccgauugucugcacgagaaguacggaggccugaacaaaucuaagccuuauuacacaggcgaacaugcgaaggccaucgggaacugcccgauuugggucaaaacaccccucaagcuggcuaauggaacaaaauaccgcccucccgccaaacuucugaaggagagaggcuuuuucggggcuaucgccggauuucucgagggcgggugggaaggcaugaucgccggauggcacggcuauacgagccauggggcucacggaguggcgguugccgcugaccugaaguccacccaggaggccauuaacaagaucaccaaaaaucuuaacagccugucugaacucgaggugaagaaucugcaacggcuguccggcgccauggaugaacuccacaacgagauucuggagcuugacgaaaaagucgacgaucugcgcgcugacaccaucagcucucagauugagcucgccgugcugcuuagcaaugaagggaucaucaacuccgaggaugaacaucugcucgcgcuggagagaaagcugaaaaagaugcucggaccuucugcugucgacauuggcaauggguguuucgagacaaagcacaaaugcaaccagaccugccuggaucggaucgccgccggcacguuuaaugcuggagaguucagccuucccaccuuugacucccugaacauuacagccgcuagccucaaugaugacggccuggauaaccauaccauccugcuuuacuauucuacagccgcguccagccucgccgugacccugaugauugcuaucuucauuguuuacaugaucucuagagacaauguguccuguagcaucugccuguga

SEQ ID NO: 209427 - RNA, 1755 nt, Artificial Sequence
  derived and/or modified sequence opt5 from hemagglutinin__InfluenzaB__ABL76342
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgguggaggucccccacauuuguaccaaggaagaggaucagaucacaguuuggggguuccauuccgacaacaaaacccagaugaagaaucuguacggagauagcaacccgcaaaaguuuacaucuuccgccaauggcgugaccacgcacuaugugagccagauuggggacuucccugaucagacagaggacggaggccucccccagucuggccgcaucgucguggauuacaugguucaaaaaccugggaagaccggaaccauuguguaucagagaggcauccugcuuccccagaaagucuggugcgcuuccgggcggagcaaggugauccgcggaucccugccccucauuggcgaagccgacugucugcacgagaaauacgggggacugaacaagucuaaaccuuauuacacaggcgaacaugcgaaggccaucggcaacugcccgauuuggguuaagacaccccucaaacuggcuaaugggaccaaguacagaccucccgccaaacuucugaaggagcggggauuuuucggcgcuaucgccggguuucucgagggaggcugggaagggaugauugccggcuggcacggauauacgagccauggcgcucacgggguggcggucgccgcugaucugaaauccacccaggaggccaucaacaagaucacaaagaaucuuaacagccugucugaacucgaggugaaaaaucugcaacgccuguccggagccauggacgaacuccacaacgagauucuggagcuugacgaaaaggucgaugaccugagagcugauaccaucagcucucagauugagcucgccgugcugcuuagcaaugaaggcaucauuaacuccgaggacgaacaucugcucgcgcuggagcggaaacugaagaaaaugcucgggccuucugcuguugauaucggaaauggcuguuucgagacaaagcacaagugcaaccagaccugccuggacagaaucgccgccgggacguuuaaugcuggcgauuucagccuucccaccuuugacucccugaacauuacagccgcuagccucaaugaugacggacuggauaaccauaccauccugcuuuacuauucuacagccgcguccagccucgccgugacccugaugauugcuaucuucauugucuacaugaucucucgcgacaauguguccuguagcauuugccuguga

SEQ ID NO: 209428 - RNA, 1755 nt, Artificial Sequence
  derived and/or modified sequence opt5 from hemagglutinin__InfluenzaB__ABL76353
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgguggaggucccccacauuuguaccaaggaagaggaucagaucacaguuuggggguuccauuccgacaacaaaacccagaugaagaaucuguacggagauagcaacccgcaaaaguuuacaucuuccgccaauggcgugaccacgcacuaugugagccagauugggggauucccugaccagacagaggauggcggccucccccagucugggcgcaucgucguggacuacaugguucaaaaaccuggaaagaccggcaccauuguguaucagagagggauccugcuuccccagaaagucuggugcgcuuccggacggagcaaggugauccgcggcucccugccccucauuggggaagccgauugucugcacgagaaauacggaggccugaacaagucuaaaccuuauuacacaggcgaacaugcgaaggccaucgggaacugcccgauuuggguuaagacaccccucaaacuggcuaauggaaccaaguacagaccucccgccaaacuucugaaggagcggggcuuuuucggggcuaucgccggauuucucgagggcgggugggaaggcaugauugccggauggcacggcuauacgagccauggggcucacggaguggcggucgccgcugaccugaaauccacccaggaggccaucaacaagaucacaaagaaucuuaacagccugucugaacucgaggugaaaaaucugcaacgccuguccggcgccauggaugaacuccacaacgagauucuggagcuugacgaaaaggucgacgaucugagagcugacaccaucagcucucagauugagcucgccgugcugcuuagcaaugaagggaucauuaacuccgaggaugaacaucugcucgcgcuggagcggaaacugaagaaaaugcucggaccuucugcuguugacaucggcaauggguguuucgagacaaagcacaagugcaaccagaccugccuggauagaaucgccgccggcacguuuaaugcuggagacuucagccuucccaccuuugauucccugaacauuacagccgcuagccucaaugacgauggccuggacaaccauaccauccugcuuuacuauucuacagccgcguccagccucgccgugacccugaugauugcuaucuucauugucuacaugaucucucgcgauaauguguccuguagcauuugccuguga

SEQ ID NO: 209429 - RNA, 1755 nt, Artificial Sequence
  derived and/or modified sequence opt5 from hemagglutinin__InfluenzaB__ABL76375
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacaacaagacccagaugaagaaucuguacggagauagcaacccgcaaaaauuuacaucuuccgcuaauggcaucaccacgcacuaugucagccagauugggggauucccugaccagacagaggauggcggccucccccagucugggcggaucguuguggacuacauggugcaaaagccuggaaaaaccggcaccaucgucuaucagcgcgggauucugcuuccccagaagguguggugcgccuccggaagaagcaaaguuaucaagggcucccugccccucauuggggaagcggauugucugcacgagaaauacggaggccugaacaagucuaagccuuauuacacaggcgaacaugccaaagcuaucgggaacugcccgauuugggugaagacaccccucaaacuggccaauggaaccaaguaccggccucccgcuaaacuucugaaggagcgcggcuuuuucggggccaucgccggauuucucgagggcgggugggaaggcaugaucgcuggauggcacggcuauacgagccauggggcgcacggagucgccguggcugccgaccugaaguccacccaggaggccauuaacaaaaucacaaagaaucuuaacagccugucugaacucgagguuaaaaaucugcaaagacuguccggcgcuauggaugaacuccacaacgagauucuggagcuugacgaaaagguggacgaucugcgggccgacaccaucagcucucagauugagcucgcgguccugcuuagcaaugaagggaucaucaacuccgaggaugaacaucugcucgcucuggagcgcaaacugaagaagaugcucggaccuucugccguggacauuggcaauggguguuucgagacaaaacacaagugcaaccagaccugccuggauagaaucgccgcuggcacguuuaaugccggagaguucagccuucccaccuuugacucccugaacauuacagcugccagccucaaugaugacggccuggauaaccauaccauccugcuuuacuauucuacagcggccuccagccucgcugucacccugaugauugccaucuucauuguguacaugaucucucgggacaauguuuccuguagcaucugccuguga

SEQ ID NO: 209430 - RNA, 1755 nt, Artificial Sequence; identical to SEQ ID NO: 209429
  derived and/or modified sequence opt5 from hemagglutinin__InfluenzaB__ABL76386

SEQ ID NO: 209431 - RNA, 1755 nt, Artificial Sequence
  derived and/or modified sequence opt5 from hemagglutinin__InfluenzaB__ABL76408
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugcuuuaacuguaccgaucucgacguugcccugggacgcccuaugugcgugggcauuacacccucugccaaggcuagcauccuucacgaagucagaccugugaccuccggguguuuccccaucaugcaugaucggacgaagauucgccaacugccuaaucuccugagaggauacgagaaaauccggcugucuacacagaacguuauugacgccgaaaaggcuccgggcggccccuaucgccucgggaccagcggauccugcccuaaugccacaagcaaaucuggcuuuuucgcgaccauggccugggcugugcccagagggaacaauaagaccgccacaaacccucugacggucgaggugccccacaucuguaccaaagaagaggaucagauuacaguguggggauuucauuccgacaauaagacccagaugaagaaccuuuacggcgauagcaauccgcaaaaauucacaucuuccgcuaacgggaucaccacgcacuaugucagccagauuggaggcuuuccugaccagacagaggauggcgggcugccccagucuggacggaucguuguggacuacauggugcaaaagccuggcaaaaccgggaccaucgucuaucagcgcgggauucuccugccccagaagguguggugcgccuccggcagaagcaaaguuaucaaggggucccuuccccugauuggagaagcggauugucuccacgagaaauacggcggccugaauaagucuaagccuuauuacacaggggaacaugccaaagcuaucggaaacugcccgauuugggugaagacaccccugaaacucgccaacggcaccaaguaccggccucccgcuaaacugcuuaaggagcgcggguucuuuggagccaucgccggcuuccuggagggaggcugggaaggaaugaucgcuggcuggcacggguauacgagccauggagcgcacggcgucgccguggcugccgaccucaaguccacccaggaggccauuaauaaaaucacaaagaaccugaauagccuuucugaacuggagguuaaaaaccuccaaagacuguccggggcuauggaugaacugcacaaugagauucucgagcuggacgaaaagguggacgaucuucgggccgacaccaucagcucucagauugagcuggcgguccuccugagcaacgaaggaaucaucaauuccgaggaugaacaucuucuggcucucgagcgcaaacugaagaagaugcugggcccuucugccguggacauugggaacggcuguuuugagacaaaacacaagugcaaucagaccugccucgauagaaucgccgcuggaacguucaacgccggcgaauuuagccugcccaccuucgacucccuuaauauuacagcugccagccugaacgaugacgggcucgauaaucauaccauccugcuguacuauucuacagcggccuccagccuugcugucacccucaugauugccaucuucauuguguacaugaucucucgggacaacguuuccuguagcaucugccuguga

SEQ ID NO: 209432 - RNA, 1755 nt, Artificial Sequence
  derived and/or modified sequence opt5 from hemagglutinin__InfluenzaB__ABL76419
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugcuuuaacuguaccgaucucgacguugcccugggacgcccuaugugcgugggcauuacacccucugccaaggcuagcauccuucacgaaaucagaccugucaccuccggguguuuccccauuaugcaugaucggacgaagauccgccaacugccuaaucuccugagaggauacgagaaaauucggcugucuacacagaacgugaucgacgccgaaaaggcuccgggcggccccuaucgccucgggaccagcggauccugcccuaaugccacaagcaaaucuggcuuuuucgcgaccauggccugggcuguucccagagggaacaauaagaccgccacaaacccucugacgguggaggucccccacauuuguaccaaagaagaggaucagaucacaguguggggauuucauuccgacaauaagacccagaugaagaaccuuuacggcgauagcaauccgcaaaaauucacaucuuccgcuaacgggauuaccacgcacuaugugagccagaucggaggcuuuccugaccagacagaggauggcgggcugccccagucuggacggaucgucguugacuacauggugcaaaagccuggcaaaaccgggaccauuguguaucagcgcggaauccuccugccccagaaggucuggugcgccuccggcagaagcaaagugauuaaggggucccuuccccugaucggagaagcggauugucuccacgagaaauacggcggccugaauaagucuaagccuuauuacacaggggaacaugccaaagcuauuggaaacugcccgaucuggguuaagacaccccugaaacucgccaacggcaccaaguaccggccucccgcuaaacugcuuaaggagcgcggguucuuuggagccaucgccggcuuccuggaagggggcugggagggaaugauugcuggcuggcacggguauacgagccauggagcgcacggcguggccgucgcugccgaccucaaguccacccaggaggccaucaauaaaauuacaaagaaccugaauagccuuucugaacuggaggugaaaaaccuccaaagacuguccggggcuauggaugaacugcacaaugagauccucgagcuggacgaaaagguugacgaucuucgggccgacaccauuagcucucagaucgagcuggcggugcuccugagcaacgaaggaaucauuaauuccgaggaugaacaucuucuggcucucgagcgcaaacugaagaagaugcugggcccuucugccgucgacaucgggaacggcuguuuugagacaaaacacaagugcaaucagaccugccucgauagaauugccgcuggaacguucaacgccggcgaauuuagccugcccaccuucgacucccuuaauaucacagcugccagccugaacgaugacgggcucgauaaucauaccauucugcuguacuauucuacagcggccuccagccuugcugugacccucaugaucgccauuuucaucgucuacaugaucucucgggacaacguguccuguagcauuugccuguga

SEQ ID NO: 209433 - RNA, 1758 nt, Artificial Sequence
  derived and/or modified sequence opt5 from hemagglutinin__InfluenzaB__ABL76441
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaagccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagcccggaacaauuaccuaccaaagaggcauccuccugccucagaaaguuuggugcgccuccgggcggagcaaggugauuaaaggaucccuuccccugaucggcgaggcugacugucuccaugaaaaguauggcgggcugaacaagucuaaacccuacuacaccggagagcacgccaaggcgauuggcaauugcccuaucugggucaaaacaccgcugaagcucgccaacgggaccaaauauagacccccugcuaagcugcuuaaggagcgcggauuuuucggcgccaucgcuggguuucuggaaggcggaugggagggcaugauugccggguggcauggauacacaagccacggcgcccacgggguggcuguugcggccgaucucaaauccacgcaggaagcuaucaauaagauuaccaaaaaccugaauagccuuucugagcuggaagugaagaaccuccagcggcuguccggagccauggacgagcugcauaaugagauccucgaacuggaugagaaagucgacgaccuucgcgccgauacaauuagcucucaaaucgaacuggcugugcuccugagcaacgagggcaucauuaauuccgaagacgagcaccuucuggcccucgagagaaagcugaagaaaaugcuggggcccucugcggucgaaaucggcaacggauguuucgagaccaagcauaaaugcaaucagacaugccucgaucggauugcugccggcaccuuugacgccggggaguucagccugccuacguuugauucccuuaacaucaccgcugccagccugaaugacgaugaacucgacaaccacacaauucugcuguauuacucuaccgcugccuccagccuugcggugacacucaugaucgccauuuucguuguguauauggucucucgcgauaacguguccuguagcaucugccuguga

SEQ ID NO: 209434 - RNA, 1758 nt, Artificial Sequence
  derived and/or modified sequence opt5 from hemagglutinin__InfluenzaB__ABL76463
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcgccuccgggcggagcaaggugauuaaaggaucccuuccucugaucggcgaggcugacugucuccaugaaaaguauggcgggcugaacaagucuaaacccuacuacacaggagagcacgccaaggcgauuggcaauugccccaucugggucaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacgggguggcuguugcggccgaucucaaauccacccaggaagcuaucaauaagauuacaaagaaccugaauagccuuucugagcuggaagugaagaaccuccagcggcuguccggagccauggacgagcugcauaaugagauccucgaacuggaugagaaagucaacgaccuucgcgccgacaccauuagcucucaaaucgaacuggcugugcuccugagcaaugagggcaucauuaacuccgaagaugagcaccuucuggcccucgagagaaagcugaagaaaaugcuggggccuucugcggucgaaaucggcaauggauguuucgagacaaagcauaaaugcaaccagaccugccucgaccggauugcugccggcacguuugaugccggggaguucagccugcccaccuuugacucccuuaauaucacagcugccagccugaacgaugacggacucgauaaccacaccauucugcuguauuacucuacagcugccuccagccuugcggugacccucaugaucgccauuuucguuguguauauggucucucgcgacaauguguccuguagcaucugccuguga

SEQ ID NO: 209435 - RNA, 1758 nt, Artificial Sequence
  derived and/or modified sequence opt5 from hemagglutinin__InfluenzaB__ABL76474
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcgccuccgggcggagcaaggugauuaaaggaucccuuccucugaucggcgaggcugacugucuccaugaaaaguauggcgggcugaacaagucuaaacccuacuacacaggagagcacgccaaggcgauuggcaauugccccaucugggucaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacgggguggcuguugcggccgaucucaaauccacccaggaagcuaucaauaagauuacaaagaaccugaauagccuuucugagcuggaagugaagaaccuccagcggcuguccggagccauggacgagcugcauaaugagauccucgaacuggaugagaaagucgacgaccuucgcgccgauaccauuagcucucaaaucgaacuggcugugcuccugagcaacgagggcaucauuaauuccgaagacgagcaccuucuggcccucgagagaaagcugaagaaaaugcuggggccuucugcggucgaaaucggcaacggauguuucgagacaaagcauaaaugcaaucagaccugccucgaucggauugcugccggcacguuugacgccggggaguucagccugcccaccuuugauucccuuaacaucacagcugccagccugaaugacgaugaacucgacaaccacaccauucugcuguauuacucuacagcugccuccagccuugcggugacccucaugaucgccauuuucguuguguauauggucucucgcgauaacguguccuguagcaucugccuguga

SEQ ID NO: 209436 - RNA, 1758 nt, Artificial Sequence
  derived and/or modified sequence opt5 from hemagglutinin__InfluenzaB__ABL76485
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugugacaauggccugggcugugcccaagaacgacaauaacaaaaccgccaccaauagccugacaauugaagucccuuacaucuguacggagggagaggaucagauuaccguuuggggcuuccacucugacaacgaaacacagauggcgaaacuuuauggggauuccaagccccagaaguuuaccagcucugccaacggagugacaacccacuacgugucccaaaucggcggcuucccgaaucagacggaggacgggggacugccucagagcggccgcaucgucguggauuauaugguucagaagucugggaaaacaggaaccauuaccuaccaaagaggcauccuccugccccagaagguguggugcgcuuccgggcggagcaaagucauuaagggaucccuuccucugaucggcgaagccgacugucuccaugagaaauauggcgggcugaacaagucuaagcccuacuacacaggagagcacgcuaaagccauuggcaauugccccaucugggugaagaccccucugaaacucgcgaacgggacaaaguaucgcccgcccgccaaacugcuuaaggaaagaggauuuuucggcgcuaucgccggguuucuggagggcggaugggaaggcaugauugcuggguggcauggauacacgagccacggcgcccacgggguugccguggcugcggaucucaaguccacccaggaggccaucaauaaaauuacaaagaaccugaauagccuuucugaacuggaggucaaaaaccuccagcggcuguccggagcuauggacgagcugcauaaugaaauccucgagcuggaugaaaagguggacgaccuucgcgccgauaccauuagcucucaaaucgagcuggccguccuccugagcaacgaaggcaucauuaauuccgagaacgagcaccuucuggcucucgaaagaaaacugaagaagaugcuggggccuucugccguggagaucggcaauggauguuucgaaacaaaacauaagugcaaccagaccugccucgaccggauugcggcuggcacguuugaugccggggaguucagccugcccaccuuugacucccuuaauaucacagccgcuagccugaacgaugacggacucgauaaccacaccauucugcuguauuacucuacagccgcuuccagccuugccguuacccucaugaucgcgauuuucguggucuauauggugucucgcgacaauguuuccuguagcaucugccuguga

SEQ ID NO: 209437 - RNA, 1758 nt, Artificial Sequence
  derived and/or modified sequence opt5 from hemagglutinin__InfluenzaB__ABL76507
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaauccagauggccaaacuuuauggggauuccaagccccagaaguuuacaagcucugcuaacggaguuaccacacacuacgugucccaaaucggcggcuucccgaaucagaccgaggacgggggacugccucagagcggccgcauuguggucgauuauauggugcagaagucugggaaaacgggaacaaucaccuaccaaagaggcauucuccugccccagaagguuuggugcgccuccgggcggagcaaagugaucaagggaucccuuccucugauuggcgaagcugacugucuccaugagaaauauggcgggcugaacaagucuaagcccuacuacaccggagagcacgccaaagcgaucggcaauugccccaucugggucaagacaccucugaaacucgccaacgggaccaaguaucgcccgcccgcuaaacugcuuaaggaaagaggauuuuucggcgccauugcuggguuucuggagggcggaugggaaggcaugaucgccggguggcauggauacacaagccacggcgcccacgggguggcuguugcggccgaucucaaguccacgcaggaggcuauuaauaaaaucaccaagaaccugaauagccuuucugaacuggaggugaaaaaccuccagcggcuguccggagccauggacgagcugcauaaugaaauucucgagcuggaugaaaaggucgacgaccuucgcgccgauacaaucagcucucaaaucgagcuggcugugcuccugagcaacgaaggcauuaucaauuccgaggacgagcaccuucuggcccucgaaagaaaacugaagaagaugcuggggccuucugcggucgagauuggcaacggauguuucgaaaccaaacauaagugcaaucagacaugccucgaucggaucgcugccggcaccuuugacgccggggaguucagccugcccacguuugauucccuuaacauuaccgcugccagccugaaugacgauggacucgacaaccacacaauccugcuguauuacucuaccgcugccuccagccuugcggugacacucaugauugccaucuucguuguguauauggucucucgcgauaacguguccuguagcaucugccuguga

SEQ ID NO: 209438 - RNA, 1758 nt, Artificial Sequence
  derived and/or modified sequence opt5 from hemagglutinin__InfluenzaB__ABL76518
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaaaccagauggccaaacuuuauggggauuccaagccccagaaguuuacaagcucugcuaauggaguuaccacacacuacgugucccaaaucggcggcuucccgaaccagaccgaggacgggggacugccucagagcggccgcaucguggucgauuauauggugcagaagucugggaaaacgggaacaauuaccuaccaaagaggcauccuccugccccagaagguuuggugcgccuccgggcggagcaaagugauuaagggaucccuuccucugaucggcgaagcugacugucuccaugagaaauauggcgggcugaauaagucuaagcccuacuacaccggagagcacgccaaagcgauuggcaacugccccaucugggucaagacaccucugaaacucgccaaugggaccaaguaucgcccgcccgcuaaacugcuuaaggaaagaggauuuuucggcgccaucgcuggguuucuggagggcggaugggaaggcaugauugccggguggcauggauacacaagccacggcgcccacgggguggcuguugcggccgaucucaaguccacgcaggaggcuaucaacaaaauuaccaagaaucugaacagccuuucugaacuggaggugaaaaaucuccagcggcuguccggagccauggacgagcugcauaacgaaauccucgagcuggaugaaaaggucgacgaccuucgcgccgauacaauuagcucucaaaucgagcuggcugugcuccugagcaaugaaggcaucauuaacuccgaggacgagcaccuucuggcccucgaaagaaaacugaagaagaugcuggggccuucugcggucgagaucggcaauggauguuucgaaaccaaacauaagugcaaccagacaugccucgaucggauugcugccggcaccuuugacgccggggaguucagccugcccacguuugauucccuuaauaucaccgcugccagccugaacgacgauggacucgacaaccacacaauucugcuguauuacucuaccgcugccuccagccuugcggugacacucaugaucgccauuuucguuguguauauggucucucgcgauaauguguccuguagcaucugccuguga

SEQ ID NO: 209439 - RNA, 1758 nt, Artificial Sequence
  derived and/or modified sequence opt5 from hemagglutinin__InfluenzaB__ABL76529
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugugacaauggccugggcugugcccaagaacgacaauaacaaaaccgccaccaauagccugacaauugaagucccuuacaucuguacggagggagaggaucagauuaccguuuggggcuuccacucugacaacgaaacacagauggcgaaacuuuauggggauuccaagccccagaaguuuaccagcucugccaacggagugacaacccacuacgugucccaaaucggcggcuucccgaaucagacggaggacgggggacugccucagagcggccgcaucgucguggauuauaugguucagaagucugggaaaacaggaaccauuaccuaccaaagaggcauccuccugccccagaagguguggugcgcuuccgggcggagcaaagucauuaagggaucccuuccucugaucggcgaagccgacugucuccaugagaaauauggcgggcugaacaagucuaagcccuacuacacaggagagcacgcuaaagccauuggcaauugccccaucugggugaagaccccucugaaacucgcgaacgggacaaaguaucgcccgcccgccaaacugcuuaaggaaagaggauuuuucggcgcuaucgccggguuucuggagggcggaugggaaggcaugauugcuggguggcauggauacacgagccacggcgcccacgggguugccguggcugcggaucucaaguccacccaggaggccaucaauaaaauuacaaagaaccugaauagccuuucugaacuggaggucaaaaaccuccagcggcuguccggagcuauggacgagcugcauaaugaaauccucgagcuggaugaaaagguggacgaccuucgcgccgauaccauuagcucucaaaucgagcuggccguccuccugagcaacgaaggcaucauuaauuccgaggacgagcaccuucuggcucucgaaagaaaacugaagaagaugcuggggccuucugccguggagaucggcaacggauguuucgaaacaaaacauaagugcaaucagaccugccucgaucggauugcggcuggcacguuugacgccggggaguucagccugcccaccuuugauucccuuaacaucacagccgcuagccugaaugacgauggacucgacaaccacaccauucugcuguauuacucuacagccgcuuccagccuugccguuacccucaugaucgcgauuuucguggucuauauggugucucgcgauaacguuuccuguagcaucugccuguga

SEQ ID NO: 209440 - RNA, 1758 nt, Artificial Sequence
  derived and/or modified sequence opt5 from hemagglutinin__InfluenzaB__ABL76540
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugaaaccuguuacauccggguguuuucccaucaugcaugauagaaccaagauucggcaacucccuaaccugcugcgcggauacgaacacaucagacucucuacgcauaaugugauuaacgccgagaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaagugccuuacaucuguacggagggagaggaucagauuaccgucuggggcuuccacucugacaacgaaacacagauggccaaacuuuauggggauuccaaaccccagaaguuuaccagcucugcuaacggaguuacaacccacuacgugucccaaaucggcggcuucccgaaucagacggaggacgggggacugccucagagcggccggaucguggucgauuauauggugcagaaaucugggaagacaggaaccauuaccuaccaacgcggcauccuccugccccagaaaguuuggugcgccuccgggagaagcaaggugauuaaaggaucccuuccucugaucggcgaagcugacugucuccaugagaaguauggcgggcugaacaagucuaaacccuacuacacaggagagcacgccaaggcgauuggcaauugccccaucugggucaaaaccccucugaagcucgccaacgggacaaaauaucggccgcccgcuaagcugcuuaaggaacgcggauuuuucggcgccaucgcuggguuucuggagggcggaugggaaggcaugauugccggguggcauggauacacgagccacggcgcccacgggguggcuguugcggccgaucucaaauccacccaggaggcuaucaauaagauuacaaagaaccugaauagccuuucugaacuggaggugaagaaccuccagagacuguccggagccauggacgagcugcauaaugaaauccucgagcuggaugaaaaagucgacgaccuucgggccgauaccauuagcucucaaaucgagcuggcugugcuccugagcaacgaaggcaucauuaauuccgaggacgagcaccuucuggcccucgaacgcaagcugaagaaaaugcuggggccuucugcggucgagaucggcaacggauguuucgaaacaaagcauaaaugcaaucagaccugccucgauagaauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgggauaacguguccuguagcaucugccuguga

SEQ ID NO: 209441 - RNA, 1758 nt, Artificial Sequence
  derived and/or modified sequence opt5 from hemagglutinin__InfluenzaB__ABL76551
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaagcugacugucuccaugagaaauauggcgggcugaacaagucuaagcccuacuacacaggagagcacgccaaagcgauuggcaauugccccaucugggucaagaccccucugaaacucgccaacgggacaaaguaucgcccgcccgcuaaacugcuuaaggaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaauaaaauuacaaagaaccugaauagccuuucugaacuggaggugaaaaaccuccagcggcuguccggagccauggacgagcugcauaaugaaauccucgagcuggaugaaaaggucgacgaccuucgcgccgauaccauuagcucucaaaucgagcuggcugugcuccugagcaacgaaggcaucauuaauuccgaggacgagcaccuucuggcccucgaaagaaaacugaagaagaugcuggggccuucugcggucgagaucggcaacggauguuucgaaacaaaacauaagugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugauggccaucuucguuguguauauggucucucgcgauaacguguccuguagcauuugccuguga

SEQ ID NO: 209442 - RNA, 1758 nt, Artificial Sequence
  derived and/or modified sequence opt5 from hemagglutinin__InfluenzaB__ABL76562
augaaggccaucauugugcugcucauggucguuaccagcaacgcugacagaaucugcacacggauuacguccucuaauagcccccacguggugaaaaccgccacacagggcgaggucaacgugaccgggguuaucccucugacaaccacaccgaccaagucccauuucgcgaaucuuaaaggaacgaagacccgcggcaaacugugucccaagugccucaacuguacagaucuggacguggcucuugggagaccuaagugcaccggaaauauucccucugccgaagucagcauccugcacgaggugcggccuguuacauccggcuguuuucccaucaugcaugaucgcaccaaaauuagacaacucccuaaccugcugcggggguacgaacacauccgccucucuacgcauaaugugauuaacgccgagaaggcuccgggaggccccuauaaaaucggcacaagcggguccugcccuaaugucaccaacggaaauggcuucuuugccacaauggcuugggccgugcccaagaacgacaauaacaaaaccgcgaccaauagccugacaauugaagugccuuacaucuguacggagggggaggaucagauuaccgucuggggauuccacucugacaacgaaacacagauggccaaacuuuauggcgauuccaagccccagaaguuuaccagcucugcuaacgggguuacaacccacuacgugucccaaaucggaggcuucccgaaucagacggaggacggcgggcugccucagagcggaagaaucguggucgauuauauggugcagaagucuggcaaaacagggaccauuaccuaccaacggggaauccuccugccccagaagguuuggugcgccuccggccgcagcaaagugauuaaggggucccuuccucugaucggagaagcugacugucuccaugagaaauauggcggccugaacaagucuaagcccuacuacacaggggagcacgccaaagcgauuggaaauugccccaucugggucaagaccccucugaaacucgccaacggcacaaaguauagaccgcccgcuaaacugcuuaaggaacggggguuuuucggagccaucgcuggcuuucuggaagggggcugggagggaaugauugccggcuggcauggguacacgagccacggagcccacggcguggcuguugcggccgaucucaaguccacccaggaggcuaucaauaaaauuacaaagaaccugaauagccuuucugaacuggaggugaaaaaccuccagcgccuguccggggccauggacgagcugcauaaugaaauccucgagcuggaugaaaaggucgacgaccuuagagccgauaccauuagcucucaaaucgagcuggcugugcuccugagcaacgaaggaaucauuaauuccgaggacgagcaccuucuggcccucgaacggaaacugaagaagaugcugggcccuucugcggucgagaucgggaacggcuguuucgaaacaaaacauaagugcaaucagaccugccucgaucgcauugcugccggaacguuugacgugggcgaguucagccugcccaccuuugauucccuuaacaucacagccgcuagccugaaugacgaugggcucgacaaccacaccauucugcuguauuacucuacagccgcuuccagccuugccguuacccucaugaucgcgauuuucguggucuauauggugucuagagauaacguuuccuguagcaucugccuguga

SEQ ID NO: 209443 - RNA, 1758 nt, Artificial Sequence
  derived and/or modified sequence opt5 from hemagglutinin__InfluenzaB__ABL76573
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaagcugacugucuccaugagaaauauggcgggcugaacaagucuaagcccuacuacacaggagagcacgccaaagcgauuggcaauugccccaucugggucaagaccccucugaaacucgccaacgggacaaaguaucgcccgcccgcuaaacugcuuaaggaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaauaaaauuacaaagaaccugaauagccuuucugaacuggaggugaaaaaccuccagcggcuguccggagccauggacgagcugcauaaugaaauccucgagcuggaugaaaaggucgacgaccuucgcgccgauaccauuagcucucaaaucgagcuggcugugcuccugagcaacgaaggcaucauuaauuccgaggacgagcaccuucuggcccucgaaagaaaacugaagaagaugcuggggccuucugcggucgagaucggcaacggauguuucgaaacaaaacauaagugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgcgauaacguguccuguagcaucugccuguga

SEQ ID NO: 209444 - RNA, 1758 nt, Artificial Sequence; identical to SEQ ID NO: 209443
  derived and/or modified sequence opt5 from hemagglutinin__InfluenzaB__ABL76584

SEQ ID NO: 209445 - RNA, 1758 nt, Artificial Sequence; identical to SEQ ID NO: 209443
  derived and/or modified sequence opt5 from hemagglutinin__InfluenzaB__ABL76595

SEQ ID NO: 209446 - RNA, 1758 nt, Artificial Sequence; identical to SEQ ID NO: 209443
  derived and/or modified sequence opt5 from hemagglutinin__InfluenzaB__ABL76606

SEQ ID NO: 209447 - RNA, 1758 nt, Artificial Sequence
  derived and/or modified sequence opt5 from hemagglutinin__InfluenzaB__ABL76617
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccaaggucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaagcugacugucuccaugagaaauauggcgggcugaacaagucuaagcccuacuacacaggagagcacgccaaagcgauuggcaauugccccaucugggucaagaccccucugaaacucgccaacgggacaaaguaucgcccgcccgcuaaacugcuuaaggaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaauaaaauuacaaagaaccugaauagccuuucugaacuggaggugaaaaaccuccagcggcuguccggagccauggacgagcugcauaaugaaauccucgagcuggaugaaaaggucgacgaccuucgcgccgauaccauuagcucucaaaucgagcuggcugugcuccugagcaacgaaggcaucauuaauuccgaggacgagcaccuucuggcccucgaaagaaaacugaagaagaugcuggggccuucugcggucgagaucggcaacggauguuucgaaacaaaacauaagugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgcgauaacguguccuguagcaucugccuguga

SEQ ID NO: 209448 - RNA, 1755 nt, Artificial Sequence
  derived and/or modified sequence opt5 from hemagglutinin__InfluenzaB__ABL76628
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccucauauuuguacggaaggggaggaucagaucaccgucuggggauuccacuccgacaauaagacacagaugaaaaaccuguauggcgauagcaauccccaaaaguuuaccucuuccgcuaacgggguuacaacccauuacgugagccagauuggaggcuucccggaccagacggaggauggcgggcucccucagucuggacggaucguggucgacuauaugaugcaaaagcccggcaaaacagggaccauuguguaccagcgcggaguucugcuuccucagaagguguggugcgccuccggcagaagcaaagucaucaaggggucccugccccucaucggagaagcggauugucugcacgagaaauauggcggccugaacaagucuaaacccuacuacaccggggaacacgccaaggcuauuggaaauugcccuaucugggugaagacaccgcucaaacuggccaacggcaccaaguaucggcccccugcuaaacuucugaaggagcgcggguuuuucggagccauugccggcuuucucgaagggggcugggaaggaaugaucgcuggcuggcauggguacacaagccacggagcgcauggcguugccguggcugccgaccugaaauccacgcaggaggccauuaauaagaucaccaagaaccuuaauagccugucugaacucgaggucaaaaaccugcaaagacuguccggggcuauggacgaacuccacaaugagauccuggagcuugaugaaaagguggacgaucugcgggccgacacaauuagcucucagaucgagcucgcgguccugcuuagcaacgaaggaauuaucaauuccgaggaugaacaucugcucgcucuggagcgcaaacugaagaaaaugcucggccccucugccguggacauugggaacggcuguuucgagaccaagcacaagugcaaucagacaugccuggauagaaucgccgcuggaaccuuuaacgccggcgaguucagccuuccuacguuugacucccugaauaucaccgcugccagccucaacgaugacgggcuggauaaucacacaauucugcuuuauuacucuaccgcggccuccagccucgcuguuacacugaugcuggccaucuucauuguguauauggucucucgggacaacguguccuguagcaucugccucuga

SEQ ID NO: 209449 - RNA, 1755 nt, Artificial Sequence
  derived and/or modified sequence opt5 from hemagglutinin__InfluenzaB__ABL76639
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaagccgggacaauuguguaucagcgcggaguucugcuuccucagaagguguggugcgcguccggcagaagcaaagucaucaaggggucccugccccucaucggagaagccgauugucugcaugagaaauacggcggccugaacaagucuaaacccuacuauaccggggaacacgcuaaggccauuggaaauugcccuaucugggugaagaccccgcucaaacuggcuaacggcacaaaguaccggcccccugccaaacuucugaaggagcgcggguuuuucggagccauugcuggcuuucucgaagggggcugggaaggaaugaucgcgggcuggcacggguauaccagccauggagcccacggcguugcuguggccgccgaccugaaauccacacaggaggcuauuaauaagaucacgaagaaccuuaauagccugucugaacucgaggucaaaaaccugcaaagacuguccggggccauggacgaacuccauaaugagauccuggagcuugaugaaaagguggacgaucugcgggcggacaccauuagcucucagaucgagcucgcuguccugcuuagcaacgaaggaauuaucaauuccgaggaugaacaucugcucgcccuggagcgcaaacugaagaaaaugcucggccccucugccguggacauugggaacggcuguuucgagacaaagcacaagugcaaucagaccugccuggauagaaucgcugccggaacauuuaacgcuggcgaguucagccuuccuaccuuugacucccugaauaucacggccgcgagccucaacgaugacgggcuggauaaucacaccauucugcuuuacuauucuacagccgcuuccagccucgccguuacccugaugcuggcuaucuucauuguguacauggucucucgggacaacguguccuguagcaucugccucuga

SEQ ID NO: 209450 - RNA, 1755 nt, Artificial Sequence
  derived and/or modified sequence opt5 from hemagglutinin__InfluenzaB__ABL76683
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucuaaacccuacuauaccggggaacacgccaaggcuauuggaaauugcccuaucugggugaagacaccgcucaaacuggccaacggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaauccacgcaggaggccauuaauaagaucaccaagaaccuuaauagccugucugaacucgaggucaaaaaccugcaaagacuguccggggcuauggacgaacuccauaaugagauccuggagcuugaugaaaagguggacgaucugcgggccgacacaauuagcucucagaucgagcucgcgguccugcuuagcaacgaaggaauuaucaauuccgaggaugaacaucugcucgcucuggagcgcaaacugaagaaaaugcucggccccucugccguggacauugggaacggcuguuucgagaccaagcacaagugcaaucagacaugccuggauagaaucgccgcuggaaccuuuaacgccggcgaguucagccuuccuacguuugacucccugaauaucaccgcugccagccucaacgaugacgggcuggauaaucacacaauucugcuuuacuauucuaccgcggccuccagccucgcuguuacacugaugcuggccaucuucauuguguacauggucucucgggacaacguguccuguagcaucugccucuga

SEQ ID NO: 209451 - RNA, 1752 nt, Artificial Sequence
  derived and/or modified sequence opt5 from hemagglutinin__InfluenzaB__ABL76694
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaacgcgccccgggcggccccuauagacuggggaccagcggauccugcccuaacgucacaagccgggacggcuucuuugcuaccauggccugggcggugccccgcgauaauaaaaccgccacaaacccucuuacgguggagguccccuacauuuguaccaagggggaagaccagaucacaguuuggggauuccacucugauaauaaaacccagaugaagaaccuguauggcgacuccaauccgcaaaaauuuacaagcucugcuaacggggugaccacgcauuacgugucccagauuggaggcuucccuaaccagacagaggauggcgggcucccccagagcggaagaaucgucguggacuauaugguucaaaagccuggcaagaccgggaccauuguguaccagcggggaguccugcuuccccagaaaguguggugcgccucuggccgcuccaagguuaucaaagggagccugccccucaucggagaggcugauugucugcacgaaaaguauggcggccugaauaaauccaagccuuacuacacaggggagcacgccaaagcgauuggaaacugcccgaucugggugaagacaccccucaagcuggccaauggcaccaaauauagaccucccgcuaagcugcugaaagaacggggguuuuucggagccauugcuggcuuucucgaagggggcugggagggaaugaucgccggcuggcauggguacacgucucacggagcccauggcgucgcuguggcggccgaccuuaagagcacccaggaggcuauuaacaaaaucacaaagaaucuuaacucccugagcgagcucgaagucaagaaucugcaacgccugucuggggccauggaugagcuccacaacgaaauccuggagcuugacgagaaaguggacgaucugagagccgacaccauuuccagccagaucgaacucgcuguucugcuuucuaaugagggaauuaucaacagcgaagaugagcaucugcucgcccuggaacggaagcugaaaaagaugcucggcccuuccgcgguggacauugggaauggcuguuucgagacaaaacacaagugcaaccagaccugccuggauagaaucgcugccggaacguuuaaugccggcgaguucucucuucccaccuuugacagccugaacaucacagcugccucccucaaugaugacgggcuggauaaccacaccauucugcuuuauuacagcacagcugccucuucccucgcggucacccugaugaucgccauuuucaucguguauaugguuagccgcgacaacgugucuuguuccauuugccuguga

SEQ ID NO: 209452 - RNA, 1758 nt, Artificial Sequence
  derived and/or modified sequence opt5 from hemagglutinin__InfluenzaB__ABL76716
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgugaaugggacaaaguauagaccgcccgccaaacugcuuaaggaacggggauuuuucggcgcuaucgccggguuucuggagggcggaugggaaggcaugauugcuggguggcauggauacacgagccacggcgcccacgggguugccguggcugcggaucucaaauccacccaggaggccaucaacaagauuacaaagaaucugaacagccuuucugaacuggaggucaaaaaucuccagcgccuguccggagcuauggacgagcugcauaacgaaauccucgagcuggaugaaaagguggacgaccuuagagccgauaccauuagcucucaaaucgagcuggccguccuccugagcaaugaaggcaucauuaacuccgaggacgagcaccuucuggcucucgaacggaaacugaagaaaaugcuggggccuucugccguggagaucggcaauggauguuucgaaacaaagcauaagugcaaccagaccugccucgaucgcauugcggcuggcacguuugacgccggggaguucagccugcccaccuuugauucccuuaauaucacagccgcuagccugaacgacgauggacucgacaaccacaccauucugcuguauuacucuacagccgcuuccagccuugccguuacccucaugaucgcgauuuucguggucuauauggugucuagagauaauguuuccuguagcaucugccuguga

SEQ ID NO: 209453 - RNA, 1755 nt, Artificial Sequence
  derived and/or modified sequence opt5 from hemagglutinin__InfluenzaB__ABL76760
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgauugaggugccccacaucuguaccaaggaagaggaucagauuacagucuggggguuccauuccgacaacaaaacccagaugaagaaucuguacggagauagcaacccgcaaaaguuuacaucuuccgccaauggcguuaccacgcacuaugugagccagaucgggggauucccugaccagacagaggauggcggccucccccagucugggcgcauuguggucgacuacauggugcaaaaaccuggaaagaccggcaccaucguuuaucagagagggauccugcuuccccagaaaguguggugcgcuuccggacggagcaaggucauuaaaggcucccugccccucaucggggaagccgauugucugcacgagaaguacggaggccugaacaaaucuaagccuuauuacacaggcgaacaugcgaaggccauugggaacugcccgaucugggugaaaacaccccucaagcuggcuaauggaacaaaauaccgcccucccgccaaacuucugaaggagagaggcuuuuucggggcuauugccggauuucucgagggcgggugggaaggcaugaucgccggauggcacggcuauacgagccauggggcucacggaguugcgguggccgcugaccugaaguccacccaggaggccaucaacaagauuaccaaaaaucuuaacagccugucugaacucgaggucaagaaucugcaacggcuguccggcgccauggaugaacuccacaacgagauccuggagcuugacgaaaaaguggacgaucugcgcgcugacaccauuagcucucagaucgagcucgccguccugcuuagcaaugaagggauuaucaacuccgaggaugaacaucugcucgcgcuggagagaaagcugaaaaagaugcucggaccuucugcuguggacaucggcaauggguguuucgagacaaagcacaaaugcaaccagaccugccuggaucggauugccgccggcacguuugacgcuggagaguucagccuucccaccuuugauucccugaauaucacagccgcuagccucaacgacgauggccuggacaaucauaccauucugcuuuacuauucuacagccgcguccagccucgccguuacccugaugaucgcuauuuucaucguguacaugauuucuagagauaacgucuccuguagcaucugccuguga

SEQ ID NO: 209454 - RNA, 1755 nt, Artificial Sequence
  derived and/or modified sequence opt5 from hemagglutinin__InfluenzaB__ABL76771
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgauugaggugccccacaucuguaccaaggaagaggaucagauuacagucuggggguuccauuccgacgauaaaacccagaugaagaaccuguacggagacagcaauccgcaaaaguuuacaucuuccgccaacggcguuaccacgcacuaugugagccagaucgggggauucccugaucagacagaggacggcggccucccccagucugggcgcauuguggucgauuacauggugcaaaaaccuggaaagaccggcaccaucguuuaucagagagggauccugcuuccccagaaaguguggugcgcuuccggacggagcaaggucauuaaaggcucccugccccucaucggggaagccgacugucugcacgagaaguacggaggccugaauaaaucuaagccuuauuacacaggcgaacaugcgaaggccauugggaacugcccgaucugggugaaaacaccccucaagcuggcuaacggaacaaaauaccgcccucccgccaaacuucugaaggagagaggcuuuuucggggcuauugccggauuucucgagggcgggugggaaggcaugaucgccggauggcacggcuauacgagccauggggcucacggaguugcgguggccgcugaucugaaguccacccaggaggccaucaauaagauuaccaaaaaccuuaauagccugucugaacucgaggucaagaaccugcaacggcuguccggcgccauggacgaacuccacaaugagauccuggagcuugacgaaaaaguggaugaccugcgcgcugauaccauuagcucucagaucgagcucgccguccugcuuagcaacgaagggauuaucaauuccgaggacgaacaucugcucgcgcuggagagaaagcugaaaaagauccucggaccuucugcuguggauauuggcaacggguguuucgagacaaagcacaaaugcaaucagaccugccuggaccggaucgccgccggcacguuugaugcuggagaguucagccuucccaccuuugacucccugaacauuacagccgcuagccucaaugaugacggccuggauaaccauaccauccugcuuuacuauucuacagccgcguccagccucgccguuacccugaugauugcuaucuucauuguguacaugaucucuagagacaaugucuccuguagcaucugccuguga

SEQ ID NO: 209455 - RNA, 1755 nt, Artificial Sequence
  derived and/or modified sequence opt5 from hemagglutinin__InfluenzaB__ABL76782
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggaucuccuaugugcgucggcauuacacccagcgccaaggccuccauccugcacgaagugcgcccuguuaccucuggguguuuucccaucaugcaugauagaacgaagauucggcaacucccuaaucugcugcgcggauacgagaaaaucagacucagcacacagaacgugauuaauaucgaaaaggcuccgggcggccccuaucggcuggggaccuccggaagcugcccuaacgccacaucucgcuccggcuucuuugcuaccauggccugggcgguccccagagacaauaacaaaaccgccacaaauccucuuacgguggaggugccccacauuuguaccaaggaagaggaucagaucacagucuggggguuccauagcgacaacaaagcucagaugaagaaucuguacggagauucuaacccgcaaaaguuuaccuccagcgccaauggcguuacaacccacuaugugucucagauugggggauucccugaccagacggaggauggcggccucccccaguccgggcggaucguggucgacuacauggugcaaaaaccuggaaagacaggcaccaucguuuaucagcgcgggauucugcuuccccagaaaguguggugcgcuagcggaagauccaaggucaucaaaggcucucugccccucauuggggaagccgauugucugcacgagaaguacggaggccugaacaaaagcaagccuuauuacaccggcgaacaugcgaaggccaucgggaacugcccgauuugggugaaaacaccccucaagcuggcuaauggaaccaaauaccggccucccgccaagcugcugaaagagcgcggcuuuuucggggcuaucgccggauuucucgagggcgggugggaaggcaugaucgccggauggcacggcuauacaucccauggggcucacggaguugcgguggccgcugaccuuaagagcacgcaggaggccauuaacaagaucaccaaaaaucuuaacucucuguccgaacucgaggucaagaaucugcaaagacugagcggcgccauggaugaacuccacaacgagauucuggagcuugacgaaaaaguggacgaucugcgggcugacacaaucucuagccagauugagcucgccguccugcuuuccaaugaagggaucaucaacucugaggaugaacaucugcucgcgcuggagcgcaagcugaaaaagaugcucggaccuagcgcuguggacauuggcaauggguguuucgagaccaagcacaaaugcaaccagacaugccuggauagaaucgccgccggcaccuuuaaugcuggagaguucucccuucccacguuugacagccugaacauuaccgccgcuucucucaaugaugacggccuggauaaccauacaauccugcuuuacuauuccaccgccgcgagcucucucgccguuacacugaugauugcuaucuucauuguguacaugaucucccgggacaaugucagcuguuccaucugccuguga

SEQ ID NO: 209456 - RNA, 1755 nt, Artificial Sequence; identical to SEQ ID NO: 209429
  derived and/or modified sequence opt5 from hemagglutinin__InfluenzaB__ABL76793

SEQ ID NO: 209457 - RNA, 1755 nt, Artificial Sequence; identical to SEQ ID NO: 209429
  derived and/or modified sequence opt5 from hemagglutinin__InfluenzaB__ABL76815

SEQ ID NO: 209458 - RNA, 1758 nt, Artificial Sequence
  derived and/or modified sequence opt5 from hemagglutinin__InfluenzaB__ABL76826
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccgaaugccucaacuguacagaucuggacguggcucuuggacgcccuaagugcaccggcaauauucccucugccaaggucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaagcugacugucuccaugagaaauauggcgggcugaacaagucuaagcccuacuacacaggagagcacgccaaagcgauuggcaauugccccaucugggucaagaccccucugaaacucgccaacgggacaaaguaucgcccgcccgcuaaacugcuuaaggaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaauaaaauuacaaagaaccugaauagccuuucugaacuggaggugaaaaaccuccagcggcuguccggagccauggacgagcugcauaaugaaauccucgagcuggaugaaaaggucgacgaccuucgcgccgauaccauuagcucucaaaucgagcuggcugugcuccugagcaacgaaggcaucauuaauuccgaggacgagcaccuucuggcccucgaaagaaaacugaagaagaugcuggggccuucugcggucgagaucggcaacggauguuucgaaacaaaacauaagugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgcgauaacguguccuguagcaucugccuguga

SEQ ID NO: 209459 - RNA, 1758 nt, Artificial Sequence
  derived and/or modified sequence opt5 from hemagglutinin__InfluenzaB__ABL76837
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaagugcgccaacucccuaaccugcugagaggauacgaacacauucggcucucuacgcauaaugucaucaacgccgagaaggcuccgggcggccccuauaaaauugggacaagcggauccugcccuaaugugaccaacggcaauggguucuuugccacaauggcuugggccgugcccaagaacgacaauaacaaaaccgcgaccaauagccugacagucgaaguuccuuacaucuguacggagggagaggaucagauuaccguguggggcuuccacucugacuccgaaacacagauggccaaacuuuauggggauagcaagccccagaaauuuaccucuuccagcaacggagugacaacccacuacgucucucaaaucggcggcuucccgaaccagacggaggacgggggacugccucaguccggccgcauugugguugauuauauggugcaaaagagcgggaaaacaggaaccaucaccuaccagagaggcauccuccugccccagaaggucuggugcgcuuccgggcggucuaaagugauuaagggaagccuuccucugaucggcgaagccgacugucuccaugagcgcuauggcgggcugaauaaauccaagcccuacuacacaggagagcacgcuaaggccauuggcaacugccccaucuggguuaaaaccccucugaagcucgcgaaugggacaaaauauagaccgcccgccaagcugcuuaaagaacggggauuuuucggcgcuauugccggguuucuggagggcggaugggaaggcaugaucgcuggguggcauggauacacgagccacggcgcccacgggguggccgucgcugcggaucucaagucuacccaggaggccaucaacaagauuacaaagaaucugaacucccuuagcgaacuggaggugaagaaucuccagcgccugucuggagcuauggacgagcugcauaacgaaauccucgagcuggaugaaaaagucgacgaccuuagagccgauaccauuagcucccaaaucgagcuggccgugcuccugucuaaugaaggcauuaucaacagcgaggacgagcaccuucuggcucucgaacggaagcugaaaaagaugcuggggccuuccgccguugagaucggcaauggauguuucgaaacaaagcauaaaugcaaccagaccugccucgaucgcauugcggcuggcacguuugacgccggggaguucagccugcccaccuuugauucucuuaauaucacagccgcuucccugaacgacgauggacucgacaaucacaccauucugcuguauuacagcacagccgcuucuucccuugccgugacccucaugaucgcgauuuucgucguguauaugguuagcagagauaacguguccuguucuaucugccuguga

SEQ ID NO: 209460 - RNA, 1755 nt, Artificial Sequence
  derived and/or modified sequence opt5 from hemagglutinin__InfluenzaB__ABL76848
augaaggccaucauugugcugcucauggucguuaccagcaacgcugacagaaucugcacaggcauuacguccucuaauagcucccacguggugaaaaccgccacacagggggaagucaacgugaccggagcgaucccccugacaaccacaccuaccaagucucauuucgcuaaucuuaaaggcacgaagacccgggggaaacuguguccgacaugccucaacuguaccgaucuggacguugcccuuggacgccccaugugcgugggcauuacaccucccgccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacaacaagacccagaugaagaaucuguacggagauagcaacccgcaaaaauuuacaucuuccgcuaauggcaucaccacgcacuaugucagccagauugggggauucccugaccagacagaggauggcggccucccccagucugggcggaucguuguggacuacauggugcaaaagccuggaaaaaccggcaccaucgucuaucagcgcgggauucugcuuccccagaagguguggugcgccuccggaagaagcaaaguuaucaagggcucccugccccucauuggggaagcggauugucugcacgagaaauacggaggccugaacaagucuaagccuuauuacacaggcgaacaugccaaagcuaucgggaacugcccgauuugggugaagacaccccucaaacuggccaauggaaccaaguaccggccucccgcuaaacuucugaaggagcgcggcuuuuucggggccaucgccggauuucucgagggcgggugggaaggcaugaucgcuggauggcacggcuauacgagccauggggcgcacggagucgccguggcugccgaccugaaguccacccaggaggccauuaacaaaaucacaaagaaucuuaacagccugucugaacucgagguuaaaaaucugcaaagacuguccggcgcuauggaugaacuccacaacgagauucuggagcuugacgaaaagguggacgaucugcgggccgacaccaucagcucucagauugagcucgcgguccugcuuagcaaugaagggaucaucaacuccgaggaugaacaucugcucgcucuggagcgcaaacugaagaagaugcucggaccuucugccguggacauuggcaauggguguuucgagacaaaacacaagugcaaccagaccugccuggauagaaucgccgcuggcacguuuaaugccggagaguucagccuucccaccuuugacucccugaacauuacagcugccagccucaaugaugacggccuggauaaccauaccauccugcuuuacuauucuacagcggccuccagccucgcugucacccugaugauugccaucuucauuguguacaugaucucucgggacaauguuuccuguagcaucugccuguga

SEQ ID NO: 209461 - RNA, 1755 nt, Artificial Sequence; identical to SEQ ID NO: 209429
  derived and/or modified sequence opt5 from hemagglutinin__InfluenzaB__ABL76859

SEQ ID NO: 209462 - RNA, 1755 nt, Artificial Sequence
  derived and/or modified sequence opt5 from hemagglutinin__InfluenzaB__ABL76881
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcggacccgcgggaagcugugucccgauugccucaacuguacagaccuggauguggcucuuggaagaccuaugugcgucggcaccacacccucugccaaagccagcauucugcacgaagugcggccuguuaccuccggguguuuucccaucaugcaugaccgcacgaagaucagacaacucccuaaucugcugcggggauacgagaacauucgccucucuacacagaaugugaucgaugcugaaaaggccagcggcggcccguauagacuggggaccuccggaagcugccccaacgcuacaucuaaauccggcuucuuugccaccauggcgugggccgucccuaaggacaauaacaaaaaugcuaccaacccccuuacaguggaggugccuuacauuuguacggaaggggaggaucagaucaccgucuggggauuccacagcgacaaugagacacagaugaagaaccuguauggcgauucuaauccccaaaaauuuaccuccagcgccaacgggguuacaacccauuacgugucucagauuggaggcuucccggaccagaaggaagauggcgggcucccucaguccggacggaucguggucgacuauauggugcaaaagcccggcaaaacggggacaauuguuuaccagcgcggagugcugcuuccucagaaggucuggugcgcuagcggcagauccaaagugaucaaggggucucugccccucaucggagaggccgauugucugcacgaaaaauauggcggccugaacaagagcaaacccuacuacaccggggagcacgcgaaggccauuggaaauugcccuaucuggguuaagaccccgcucaaacuggcuaacggcacaaaguaucggcccccugccaaacuucugaaggagcgcggguuuuucggagcuauugccggcuuucucgaagggggcugggagggaaugaucgccggcuggcauggguacaccucccacggagcucauggcguggcggucgccgcugaccugaaaagcacacaggaagccauuaauaagaucacgaagaaccuuaauucucuguccgagcucgaagugaaaaaccugcaaagacugagcggggccauggacgagcuccacaaugagauccuggaacuugaugagaaggucgacgaucugcgggcugacaccauuucuagccagaucgaacucgccgugcugcuuuccaacgagggaauuaucaauucugaagaugagcaucugcucgcgcuggagcgcaaacugaagaaaaugcucggccccagcgcuguugacauugggaacggcuguuucgaaacaaagcacaagugcaaucagaccugccuggauagaaucgccgccggaacauuuaacgcuggcgaguucucccuuccuaccuuugacagccugaauaucacggccgcuucucucaacgaugacgggcuggauaaucacaccauucugcuuuauuacuccacagccgcgagcucucucgccgugacccugaugcuggcuaucuucauugucuauauggugucccgggacaacguuagcuguuccaucugccucuga

SEQ ID NO: 209463 - RNA, 1755 nt, Artificial Sequence
  derived and/or modified sequence opt5 from hemagglutinin__InfluenzaB__ABL76892
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcggacccgcgggaagcugugucccgauugccucaacuguacagaccuggauguggcucuuggaagaccuaugugcgucggcaccacacccucugccaaagccagcauucugcacgaagugcggccuguuaccuccggguguuuucccaucaugcaugaccgcacgaagaucagacaacucccuaaucugcugcggggauacgagaacauucgccucucuacacagaaugugaucgaugcugaaaaggccccgggcggccccuauagacuggggaccagcggauccugcccuaacgcuacaagcaaaucuggcuucuuugccaccauggcgugggccguccccaaggacaauaacaaaaaugcuaccaacccucuuacaguggaggugcccuacgucuguacggaaggggaggaucagauuaccguuuggggauuccacuccgacaauaagacacagaugaaaaaccuguauggcgauagcaauccgcaaaaguuuaccucuuccgccaacggggugacaacccauuacgugagccagaucggaggcuucccugaccagacggaggauggcgggcucccccagucuggacggauugucguggacuauaugguucaaaagccuggcaaaacagggaccaucguguaccagcgcggaguccugcuuccccagaagguguggugcgcuuccggcagaagcaaaguuauuaaggggucccugccccucaucggagaagccgauugucugcacgagaaauauggcggccugaacaagucuaaaccuuacuacaccggggaacacgcgaaggccaucggaaauugcccgauuugggugaagacaccccucaaacuggcuaacggcaccaaguaucggccucccgccaaacuucugaaggagcgcggguuuuucggagcuaucgccggcuuucucgaagggggcugggaaggaaugauugccggcuggcauggguacacaagccacggagcucauggcgucgcgguggccgcugaccugaaauccacgcaggaggccaucaauaagauuaccaagaaccuuaauagccugucugaacucgaggucaaaaaccugcaaagacuguccggggccauggacgaacuccacaaugagauccuggagcuugaugaaaagguggacgaucugcgggcugacacaaucagcucucagauugagcucgccguucugcuuagcaacgaaggaaucauuaauuccgaggaugaacaucugcucgcgcuggagcgcaaacugaagaaaaugcucggcccuucugcuguggacaucgggaacggcuguuucgagaccaagcacaagugcaaucagacaugccuggauagaauugccgccggaaccuuuaacgcuggcgaguucagccuucccacguuugacucccugaauaucaccgccgcuagccucaacgaugacgggcuggauaaucacacaauccugcuuuauuacucuaccgccgcguccagccucgccgucacacugaugcuggcuauuuucaucguguauaugguuucucgggacaacguguccuguagcauuugccucuga

SEQ ID NO: 209464 - RNA, 1755 nt, Artificial Sequence
  derived and/or modified sequence opt5 from hemagglutinin__InfluenzaB__ABL76903
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagagcgugaucgaugcugaaaaggccccgggcggccccuacagacuggggaccuccggaagcugcccuaaugcuacaucuaaauccggcuucuuugccaccauggcgugggccguccccaaggacaacaauaaaaacgcuaccaauccucuuacaguggaggugcccuauauuuguacggaaggggaggaucagaucaccgucuggggauuccauagcgacgauaagacacagaugaaaaaccuguacggcgacucuaauccgcaaaaguuuaccuccagcgccaacgggguuacaacccacuaugugucucagauuggaggcuucccugaucagacggaggacggcgggcucccccaguccggacggaucguggucgauuacaugauucaaaagccuggcaaaacagggaccaucguguaucagcgcggaguucugcuuccccagaagguguggugcgcuagcggcagauccaaagucaucaaggggucucugccccucauuggagaagccgacugucugcaugagaaauacggcggccugaauaagagcaaaccuuacuauaccggggaacacgcgaaggccaucggaaacugcccgauuugggugaagacaccccucaaacuggcuaacggcaccaaguaccggccucccgccaaacuucugaaggagcgcggguuuuucggagcuaucgccggcuuucucgaagggggcugggaaggaaugauugccggcuggcacggguauacaucccauggagcucacggcguugcgguggccgcugaccugaaaagcacgcaggaggccaucaauaagaucaccaagaaccuuaauucucuguccgaacucgaggucaaaaaccugcaaagacugagcggggccauggaugaacuccauaaugagauucuggagcuugacgaaaagguggaugaccugcgggcugauacaaucucugcccagauugagcucgcgguccugcuuagcaacgaaggaaucauuaauuccgaggacgaacaucugcucgcucuggagcgcaaacugaagaaaaugcucggcccuucugccguggauaucgggaacggcuguuucgagaccaagcacaagugcaaucagacaugccuggacagaaucgccgcuggaaccuuuaacgccggcgaguucagccuucccacguuugauucccugaauauuaccgcugccagccucaacgacgaugggcuggacaaucacacaauccugcuuuacuauucuaccgcggccuccagccucgcuguuacacugaugcuggccauuuucaucguguacauggucucucgggacaacguguccuguagcauuugccucuga

SEQ ID NO: 209465 - RNA, 1758 nt, Artificial Sequence
  derived and/or modified sequence opt5 from hemagglutinin__InfluenzaB__ABL76914
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaagcccagauggcuaagcuguauggggauuccaagccccagaaauuuacaucuagcuccaacggaguuaccacacacuacgugagccaaaucggcggcuucccgaaucagaccgaggacgggggacugccucagucuggccgcaucguggucgauuauauggugcagaaguccgggaaaacgggaacaauuaccuaccaaagaggcauccuccugccccagaagguuuggugcgccagcgggcgguccaaagugauuaagggaucucuuccucugaucggcgaagcugacugucuccaugagcgcuauggcgggcugaacaaaagcaagcccuacuacaccggagagcacgccaaggcgauuggcaauugccccaucugggucaaaacaccucugaagcucgccaacgggaccaaauauagaccgcccgcuaagcugcuuaaagaacggggauuuuucggcgccaucgcuggguuucuggagggcggaugggaaggcaugauugccggguggcauggauacacaucccacggcgcccacgggguggcuguugcggccgaucucaagagcacgcaggaggcuaucaauaagauuaccaaaaaccuuaauucucuuuccgaacuggaggugaagaaccuccagcgccugagcggagccauggacgagcugcauaaugaaauccucgagcuggaugaaaaagucgacgaccuuagagccgauacaauuucuagccaaaucgagcuggcugugcuccuguccaacgaaggcaucauuaauucugaggacgagcaccuucuggcccucgaacggaagcugaaaaagaugcuggggccuagcgcggucgagaucggcaacggauguuucgaaaccaagcauaaaugcaaucagacaugccucgaucgcauugcugccggcaccuuugacgccggggaguucucccugcccacguuugauagccuuaacaucaccgcugccucucugaaugacgauggacucgacaaccacacaauucugcuguauuacuccaccgcugccagcucucuugcggugacacucaugaucgccauuuucguuguguauauggucuccagagauaacgugagcuguuccaucugccuguga

SEQ ID NO: 209466 - RNA, 1755 nt, Artificial Sequence
  derived and/or modified sequence opt5 from hemagglutinin__InfluenzaB__ABL76936
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcacaacccccucugccaaggccagcauucugcacgaagugagaccuguuacguccggguguuuucccaucaugcaugaucggacaaagauccgccaacucccuaaucugcugagaggauacgagaaaauucggcucucuacccagaacgugaucaaugcugaaaaggccccgggcggccccuaucgccuggggacaagcggauccugcccuaacgcuaccagcagaucuggcuucuuugccaccauggcgugggccgucccccgggacaauaacaaaacagcuacgaauccucuuaccguggaggugcccuacauuuguacaaaggaagaggaucagaucaccgucuggggguuccacuccgacgauaaaacacagaugaagaaccuguauggagacagcaauccgcaaaaguuuaccucuuccgccaacggcguuacgacacauuacgugagccagauugggggauucccugaucagaccgaggacggcggccucccccagucugggcgcaucguggucgauuauauggugcaaaaaccuggaaagaccggcacaauuguuuaccagagaggggugcugcuuccccagaaagucuggugcgcuuccggacggagcaaggugaucaaaggcucccugccccucaucggggaagccgacugucugcacgagaaguauggaggccugaauaaaucuaagccuuacuacaccggcgaacacgcgaaggccauugggaacugcccgaucuggguuaaaacaccccucaagcuggcuaacggaacgaaauaucgcccucccgccaagcugcugaaagagagaggcuuuuucggggcuauugccggauuucucgagggcgggugggaaggcaugaucgccggauggcauggcuacaccagccacggggcucauggaguggcggucgccgcugaucugaaguccacacaggaggccauuaauaagaucaccaaaaaccuuaauagccugucugaacucgaggugaagaaccugcaacggcuguccggcgccauggacgaacuccacaaugagauccuggagcuugacgaaaaagucgaugaccugcgcgcugauacaauuagcucucagaucgagcucgccgugcugcuuagcaacgaagggauuaucaauuccgaggacgaacaccuucucgcgcuggagagaaagcugaaaaagaugcucggaccuucugcuguugauauuggcaacggguguuucgagaccaagcauaaaugcaaucagacgugccuggaccggaucgccgccggcaccuuuaacgcuggagaguucagccuucccacauuugauucccugaauaucaccgccgcuagccucaacgacgauggccuggacaaucacacaauucugcuuuauuacucuaccgccgcguccagccucgccgugacgcugaugaucgcuauuuucaucgucuauauggugucuagagauaacguuuccuguagcauuugccuguga

SEQ ID NO: 209467 - RNA, 1755 nt, Artificial Sequence
  derived and/or modified sequence opt5 from hemagglutinin__InfluenzaB__ABL76947
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcagaucuggcuucuuugcgaccauggccugggcugugccccgggacaauaacaaaaccgccacaaauccucuuacggucgaggugccccacaucuguaccaaggaagaggaucagauuacaguguggggguuccauuccgacgauaaaacccagaugaagaaccuguacggagacagcaauccgcaaaaguuuacaucuuccaccaacggcaucacgacacacuaugucagccagauugggggauucccugaucagaccgaggacggcggccucccccagucugggcgcaucguuguggauuacauggugcaaaaaccuggaaagaccggcacaaucgucuaucagagagggauucugcuuccccagaaaguguggugcgcuuccggacggagcaagguuaucaaaggcucccugccccucauuggggaagccgacugucugcacgagaaguacggaggccugaauaaaucuaagccuuauuacaccggcgaacaugcgaaggccaucgggaacugcccgauuugggugaaaacaccccucaagcuggcuaacggaacgaaauaccgcccucccgccaaacuucugaaggagagaggcuuuuucggggcuaucgccggauuucucgagggcgggugggaaggcaugaucgccggauggcacggcuauaccagccauggggcucacggagucgcgguggccgcugaucugaaguccacacaggaggccauuaauaagaucaccaaaaaccuuaauagccugucugaacucgagguuaagaaccugcaacggcuguccggcgccauggacgaacuccacaaugagauucuggagcuugacgaaaaaguggaugaccugcgcgcugauacaaucagcucucagauugagcucgccguccugcuuagcaacgaagggaucaucaauuccgaggacgaacaucugcucgcgcuggagagaaagcugaaaaagaugcucggaccuucugcuguggauauuggcaacggguguuucgagaccaagcacaaaugcaaucagacgugccuggaccggaucgccgccggcaccuuuaacgcuggagaguucagccuucccacauuugauucccugaauauuaccgccgcuagccucaacgacgauggccuggacaaucauacaauccugcuuuacuauucuaccgccgcguccagccucgccgucacgcugaugauugcuaucuucauuguguacaugaucucuagagauaacguuuccuguagcaucugccuguga

SEQ ID NO: 209468 - RNA, 1758 nt, Artificial Sequence
  derived and/or modified sequence opt5 from hemagglutinin__InfluenzaB__ABL76958
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgaggcccagauggcuaaacuuuauggggauuccaagccccagaaguuuacaagcucugccaacggaguuaccacacacuacgugucccaaaucggcggcuucccgaaucagaccgaagacgggggacugccucagagcggccgcaucguggucgauuauauggugcagaaaucugggaagacgggaacaauuaccuaccaaagaggcauccuccugccccagaaaguuuggugcgcuuccgggcggagcaaggugauuaaaggaucccuuccucugaucggcgaggccgacugucuccaugaaaaguauggcgggcugaacaagucuaaacccuacuacaccggagagcacgcgaaggccauuggcaauugccccaucugggucaaaacaccucugaagcucgcuaacgggaccaaauaucgcccgcccgccaagcugcuuaaggagagaggauuuuucggcgcuaucgccggguuucuggaaggcggaugggagggcaugauugccggguggcauggauacacaagccacggcgcucacgggguggcgguugccgcugaucucaaauccacgcaggaagccaucaauaagauuaccaaaaaccugaauagccuuucugagcuggaagugaagaaccuccagcggcuguccggagccauggacgagcugcauaaugagauccucgaacuggaugagaaagucgacgaccuucgcgcugauacaauuagcucucaaaucgaacuggccgugcuccugagcaacgagggcaucauuaauuccgaagacgagcaccuucuggcgcucgagagaaagcugaagaaaaugcuggggccuucugcugucgaaaucggcaacggauguuucgagaccaagcauaaaugcaaucagacaugccucgaucggauugccgccggcaccuuuaacgcuggggaguucagccugcccacguuugacucccuuaauaucaccgccgcuagccugaacgaugacggacucgauaaccacacaauucugcuguauuacucuaccgccgcguccagccuugccgugacacucaugaucgcuauuuucguuguguauauggucucucgcgacaauaucuccuguagcaucugccuguga

SEQ ID NO: 209469 - RNA, 1758 nt, Artificial Sequence
  derived and/or modified sequence opt5 from hemagglutinin__InfluenzaB__ABL76969
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgcggacccgcgggaagcugugucccaaaugccucaacuguacagaucuggacguggcucuuggaagaccuaagugcaccggcaauauucccucugccaaggucagcauccugcacgaagugcggccuguuacauccggguguuuucccaucaugcaugaucgcaccaaaauuagacaacucccuaaccugcugcggggauacgagcacauccgccucucuauucauaaugugaucaacgccgaaaaggcuccgggcggccccuauaaaauugggacgagcggauccugcccuaaugucacaaacggcaauggguucuuugccaccauggcuugggccgugcccaagaacgacaauaacaaaacagcgaccaauagccugaccaucgaggugccuuacauuuguacagaaggagaggaucagaucacggucuggggcuuccacucugacaacgaggcccagauggcuaaacuuuauggggauuccaagccccagaaguuuaccagcucugccaacggaguuacaacccacuacgugucccaaaucggcggcuucccgaaucagacagaagacgggggacugccucagagcggcagaauuguggucgauuauauggugcagaagucugggaaaaccggaacgaucacauaccaacggggcauucuccugccccagaagguuuggugcgcuuccgggcgcagcaaagugaucaagggaucccuuccucugauuggcgaggccgacugucuccaugaaaaauauggcgggcugaacaagucuaagcccuacuacaccggagagcacgcgaaagccaucggcaauugccccaucugggucaagaccccucugaaacucgcuaacgggacaaaguauagaccgcccgccaaacugcuuaaggagcggggauuuuucggcgcuauugccggguuucuggaaggcggaugggagggcaugaucgccggguggcauggauacaccagccacggcgcucacgggguggcgguugccgcugaucucaaguccacacaggaagccauuaauaaaaucacgaagaaccugaauagccuuucugagcuggaagugaaaaaccuccagcgccuguccggagccauggacgagcugcauaaugagauucucgaacuggaugagaaggucgacgaccuuagagcugauaccaucagcucucaaaucgaacuggccgugcuccugagcaacgagggcauuaucaauuccgaagacgagcaccuucuggcgcucgagcggaaacugaagaagaugcuggggccuucugcugucgaaauuggcaacggauguuucgagacaaaacauaagugcaaucagaccugccucgaucgcaucgccgccggcacauuugacgcuggggaguucagccugcccaccuuugauucccuuaacauuacggccgcuagccugaaugacgauggacucgacaaccacaccauccugcuguauuacucuacagccgcguccagccuugccgugacccucaugauugcuaucuucguuguguauauggucucuagagauaacguguccuguagcaucugccuguga

SEQ ID NO: 209470 - RNA, 1755 nt, Artificial Sequence
  derived and/or modified sequence opt5 from hemagglutinin__InfluenzaB__ABL76980
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacgcuacaagcaaaucuggcuucuuugccaccauggcgugggccguccccagagacaauaacaagaccgcuacaaauccucuuacgguggaggugcccuacaucuguaccaaagaagaggaucagauuacagucuggggguuccacuccgacaacaagacccagaugaagaaucuguauggagauagcgacccgcaaaaauuuacaucuuccgccaacggcguuaccacgcauuacgugagccagaucgggggauucccugaucagacagaggacggcggccucccccagucugggcggauuguggucgauuauauggugcaaaagccuggaaaaaccggcaccaucguuuaccagcgcgggauccugcuuccccagaagguguggugcgcuuccggaagaagcaaagucauuaagggcucccugccccucaucggggaagccgacugucugcacgagaaauauggaggccugaauaagucuaagccuuacuacacaggcgaacacgcgaaagccauugggaacugcccgaucugggugaagacaccccucaaacuggcuaacggaaccaaguaucggccucccgccaaacuucugaaggagcgcggcuuuuucggggcuauugccggauuucucgagggcgggugggaaggcaugaucgccggauggcauggcuacacgagccacggggcucauggaguugcgguggccgcugaucugaaguccacccaggaggccaucaauaaaauuacaaagaaccuuaauagccugucugaacucgaggucaaaaaccugcaaagacuguccggcgccauggacgaacuccacaaugagauccuggagcuugacgaaaagguggaugaccugcgggcugauaccauuagcucucagaucgagcucgccguccugcuuagcaacgaagggauuaucaauuccgaggacgaacaucugcucgcgcuggagcgcaaacugaagaagaugcucggaccuucugcuguggauaucggcaacggguguuucgagacaaaacacaagugcaaucagaccugccuggacagaauugccgccggcacguuuaacgcuggagaguucagccuucccaccuuugauucccugaauaucacagccgcuagccucaacgacgauggccuggacaaucacaccauucugcuuuauuacucuacagccgcguccagccucgccguuacccugaugaucgcuauuuucaucguguauaugauuucucgggauaacgucuccuguagcaucugccuguga

SEQ ID NO: 209471 - RNA, 1752 nt, Artificial Sequence
  derived and/or modified sequence opt5 from hemagglutinin__InfluenzaB__ABL76991
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaucacccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacaacaaaauucagaugaagaaucuguauggcgauagcaacccgcagaaauuuacaucuuccgcuaaugggaucaccacacacuacguuagccaaaucggaggcuucccuaaccagaccgaggacggcgggcucccccagucuggaagaauugugguggauuauaugguccagaagccuggcaagacggggacaaucguguaccaacggggaguucugcuuccccagaaaguguggugcgccuccggccgcagcaaggucauuaaagggucccugccccucaucggagaggcugacugucugcaugaaaaguauggcggccugaacaaaucuaagccuuacuacaccggggagcacgccaaagcgauuggaaauugcccgaucugggugaagacaccccucaagcuggccaacggcaccaaauauagaccucccgcuaagcugcugaaagaaaagggguuuuucggagccaucgcuggcuuucucgaagggggcugggagggaaugauugccggcuggcauggguacaccagccacggagcccacggcguugcuguggcggccgaucugaaauccacacaggaggcuaucaauaagauuacgaagaaccuuaauagccugucugagcucgaagucaaaaaccugcagcggcuguccggggccauggacgagcuccauaaugaaauccuggagcuugaugagaagguggacgaccugcgcgccgauaccauuagcucucaaaucgaacucgcuguccugcuuagcaacgagggaaucauuaauuccgaagacgagcaccuucucgcccuggaaagaaaacugaagaaaaugcucggcccuucugcgguggauaucgggaacggcuguuucgagacaaagcauaagugcaaucagaccugccuggaccggauugcugccggaacauuuaacgccggcgaguucagccuucccaccuuugauucccugaauaucacggcugccagccucaacgacgaugggcuggacaaucacaccauucugcuuuauuacucuacagcugccuccagccucgcgguuacccugaugaucgccauuuucaucguguauauggucucuagagauaacguguccuguagcaucugccuguga

SEQ ID NO: 209472 - RNA, 1755 nt, Artificial Sequence
  derived and/or modified sequence opt5 from hemagglutinin__InfluenzaB__ABL77002
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgauugaggugccccacaucuguaccaaggaagaggaucagauuacaaucuggggguuccauuccgacgauaaaacccagaugaagaaccuguacggagacagcaauccgcaaaaguuuacaucuuccgccaacggcgucaccacgcacuauguuagccagauugggggauucccugaucagacagaggacggcggccucccccagucugggcgcaucgugguggauuacaugguccaaaaaccuggaaagaccggcaccaucguguaucagagagggauucugcuuccccagaaaguuuggugcgcuuccggacggagcaaggugaucaaaggcucccugccccucauuggggaagccgacugucugcacgagaaguacggaggccugaauaaaucuaagccuuauuacacaggcgaacaugcgaaggccaucgggaacugcccgauuugggucaaaacaccccucaagcuggcuaacggaacaaaauaccgcccucccgccaaacuucugaaggagagaggcuuuuucggggcuaucgccggauuucucgagggcgggugggaaggcaugaucgccggauggcacggcuauacgagccauggggcucacggaguggcgguugccgcugaucugaaguccacccaggaggccauuaauaagaucaccaaaaaccuuaauagccugucugaacucgaggugaagaaccugcaacggcuguccggcgccauggacgaacuccacaaugagauucuggagcuugacgaaaaagucgaugaccugcgcgcugauaccaucagcucucagauugagcucgccgugcugcuuagcaacgaagggaucaucaauuccgaggacgaacaucugcucgcgcuggagagaaagcugaaaaagaugcucggaccuucugcugucgauauuggcaacggguguuucgagacaaagcacaaaugcaaucagaccugccuggaccggaucgccgccggcacguuugaugcuggagaguucagccuucccaccuuugacucccugaacauuacagccgcuagccucaaugaugacggccuggauaaccauaccauccugcuuuacuauucuacagccgcguccagccucgccgugacccugaugauugcuaucuucauuguuuacaugaucucuagagacaauguguccuguagcaucugccuguga

SEQ ID NO: 209473 - RNA, 1755 nt, Artificial Sequence
  derived and/or modified sequence opt5 from hemagglutinin__InfluenzaB__ABL77013
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgaagacccgggggaaacugugucccacaugccucaacuguaccgaucuggacguggcucuuggacgcccuaugugcgucggcauuacacccucugccaaggccagcauccugcaugaagugagaccuguuaccuccggguguuuucccaucaugcacgaucggacgaagauucgccaacucccuaaucugcugagaggauaugagaaaauccggcucucuacacagaacgugauuaaugcugaaaaggccccgggcggccccuaccgccuggggaccagcggauccugcccuaacgcuacaagcaaaucuggcuucuuugccaccauggcgugggccguccccagagacaauaacaagaccgcuacaaauccucuuacgguggaggugcccuauaucuguaccaaagaagaggaucagauuacagucuggggguuccauuccgacaacaagaaucagaugaagaaccuguacggagauagcgacccgcaaaaauuuaccucuuccgccaauggcguuacaacccacuaugugagccagaucgggggauucccugaucagacggaggacggcggccucccccagucugggcggauuguggucgauuacauggugcaaaagccuggaaaaacaggcaccaucguuuaucagcgcgggauccugcuuccccagaagguguggugcgcuuccggaagaagcaaagucauuaagggcucccugccccucaucggggaagccgacugucugcaugagaaauacggaggccugaacaagucuaagccuuacuauaccggcgaacacgcgaaagccauugggaacugcccgaucugggugaagacaccccucaaacuggcuaauggaaccaaguaccggccucccgccaaacuucugaaggagcgcggcuuuuucggggcuauugccggauuucucgagggcgggugggaaggcaugaucgccggauggcacggcuauacaagccauggggcucacggaguugcgguggccgcugaucugaaguccacgcaggaggccaucaacaaaauuaccaagaaucuuaacagccugucugaacucgaggucaaaaaucugcaaagacuguccggcgccauggacgaacuccauaacgagauccuggagcuugacgaaaagguggaugaccugcgggcugauacaauuagcucucagaucgagcucgccguccugcuuagcaaugaagggauuaucaacuccgaggacgaacaucugcucgcgcuggagcgcaaacugaagaagaugcucggaccuucugcuguggauaucggcaauggguguuucgagaccaaacacaagugcaaccagacaugccuggacagaauugccgccggcaccuuuaaugcuggagaguucagccuucccacguuugauucccugaacaucaccgccgcuagccucaaugacgauggccuggacaaccacacaauucugcuuuacuauucuaccgccgcguccagccucgccguuacacugaugaucgcuauuuucaucguguacaugauuucucgggauaaugucuccuguagcaucugccuguga

SEQ ID NO: 209474 - RNA, 1755 nt, Artificial Sequence
  derived and/or modified sequence opt5 from hemagglutinin__InfluenzaB__ABL77024
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacgauaagacccagaugaagaaccuguacggagacagcaauccgcaaaaauuuacaucuuccgcuaacggcaucaccacgcacuaugucagccagauugggggauucccugaucagacagaggacggcggccucccccagucugggcggaucguuguggauuacauggugcaaaagccuggaaaaaccggcaccaucgucuaucagcgcgggauucugcuuccccagaagguguggugcgccuccggaagaagcaaaguuaucaagggcucccugccccucauuggggaagcggacugucugcacgagaaauacggaggccugaauaagucuaagccuuauuacacaggcgaacaugccaaagcuaucgggaacugcccgauuugggugaagacaccccucaaacuggccaacggaaccaaguaccggccucccgcuaaacuucugaaggagcgcggcuuuuucggggccaucgccggauuucucgagggcgggugggaaggcaugaucgcuggauggcacggcuauacgagccauggggcgcacggagucgccguggcugccgaucugaaguccacccaggaggccauuaauaaaaucacaaagaaccuuaauagccugucugaacucgagguuaaaaaccugcaaagacuguccggcgcuauggacgaacuccacaaugagauucuggagcuugacgaaaagguggaugaccugcgggccgauaccaucagcucucagauugagcucgcgguccugcuuagcaacgaagggaucaucaauuccgaggacgaacaucugcucgcucuggagcgcaaacugaagaagaugcucggaccuucugccguggauauuggcaacggguguuucgagacaaaacacaagugcaaucagaccugccuggacagaaucgccgcuggcacguuuaacgccggagaguucagccuucccaccuuugauucccugaauauuacagcugccagccucaacgacgauggccuggacaaucauaccauccugcuuuacuauucuacagcggccuccagccucgcugucacccugaugauugccaucuucauuguguacaugaucucucgggauaacguuuccuguagcaucugccuguga

SEQ ID NO: 209475 - RNA, 1755 nt, Artificial Sequence
  derived and/or modified sequence opt5 from hemagglutinin__InfluenzaB__ABL77035
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcagaucuggcuucuuugcgaccauggccugggcugugccccgggacaauaacaaaaccgccacaaauccucuuacggucgaggugccccacaucuguaccaaggaagaggaucagauuacaguguggggguuccauuccgacgauaaaacccagaugaagaaccuguacggagacagcaauccgcaaaaguuuacaucuuccgcuaacggcgucaccacgcacuauguuagccagaucgggggauucccugaucagacagaggacggcggccucccccagucugggcgcauugugguggauuacaugguccaaaaaccuggaaagaccggcaccaucguguaucagagagggauccugcuuccccagaaaguuuggugcgccuccggacggagcaaggugauuaaaggcucccugccccucaucggggaagcggacugucugcacgagaaguacggaggccugaauaaaucuaagccuuauuacacaggcgaacaugccaaggcuauugggaacugcccgaucugggucaaaacaccccucaagcuggccaacggaacaaaauaccgcccucccgcuaaacuucugaaggagagaggcuuuuucggggccauugccggauuucucgagggcgggugggaaggcaugaucgcuggauggcacggcuauacgagccauggggcgcacggaguggccguugcugccgaucugaaguccacccaggaggccaucaauaagauuaccaaaaaccuuaauagccugucugaacucgaggugaagaaccugcaacggcuguccggcgcuauggacgaacuccacaaugagauccuggagcuugacgaaaaagucgaugaccugcgcgccgauaccauuagcucucagaucgagcucgcggugcugcuuagcaacgaagggauuaucaauuccgaggacgaacaucugcucgcucuggagagaaagcugaaaaagaugcucggaccuucugccgucgauaucggcaacggguguuucgagacaaagcacaaaugcaaucagaccugccuggaccggauugccgcuggcacguuuaacgccggagaguucagccuucccaccuuugauucccugaauaucacagcugccagccucaacgacgauggccuggacaaucauaccauucugcuuuacuauucuacagcggccuccagccucgcugugacccugaugaucgccauuuucaucguuuacaugauuucuagagauaacguguccuguagcaucugccuguga

SEQ ID NO: 209476 - RNA, 1755 nt, Artificial Sequence
  derived and/or modified sequence opt5 from hemagglutinin__InfluenzaB__ABL77046
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacgauaagacccagaugaagaaccuguacggagacagcaauccgcaaaaauuuacaucuuccgcuaacggcaucaccacgcacuaugucagccagauugggggauucccugaucagacagaggacggcggccucccccagucugggcggaucguuguggauuacauggugcaaaagccuggaaaaaccggcaccaucgucuaucagcgcgggauucugcuuccccagaagguguggugcgccuccggaagaagcaaaguuaucaagggcucccugccccucauuggggaagcggacugucugcacgagaaauacggaggccugaauaagucuaagccuuauuacacaggcgaacaugccaaagcuaucgggaacugcccgauuugggugaagacaccccucaaacuggccaacggaaccaaguaccggccucccgcuaaacuucugaaggagcgcggcuuuuucggggccaucgccggauuucucgagggcgggugggaaggcaugaucgcuggauggcacggcuauacgagccauggggcgcacggagucgccguggcugccgaucugaaguccacccaggaggccauuaauaaaaucacaaagaaccuuaauagccugucugaacucgagguuaaaaaccugcaaagacuguccggcgcuauggacgaacuccacaaugagauucuggagcuugacgaaaagguggaugaccugcgggccgauaccaucagcucucagauugagcucgcgguccugcuuagcaacgaagggaucaucaauuccgaggacgaacaucugcucgcucuggagcgcaaacugaagaagaugcucggaccuucugccauugauaucggcaacggguguuucgagacaaaacacaagugcaaucagaccugccuggacagaauugccgcuggcacguuuaacgccggagaguucagccuucccaccuuugauucccugaauaucacagcugccagccucaacgacgauggccuggacaaucauaccauucugcuuuacuauucuacagcggccuccagccucgcugugacccugaugaucgccauuuucaucgucuacaugaucucucgggauaacguguccuguagcauuugccuguga

SEQ ID NO: 209477 - RNA, 1755 nt, Artificial Sequence
  derived and/or modified sequence opt5 from hemagglutinin__InfluenzaB__ABL77057
augaaggccaucauugugcugcucauggucguuaccagcaaagcugacagaaucugcacaggcauuacguccucuaacagcccccacguggugaagaccgccacacagggggaggucaaugugaccggagcgaucccucugacaaccacaccgaccaaaucccauuucgcuaaccuuaagggcacgaaaacccgggggaagcugugucccacaugccucaauuguaccgaucuggacguugcccuuggacgcccuaugugcgugggcauuacacccucugccaaggcuagcauccugcacgaagucaaaccugugaccuccggguguuuucccaucaugcaugauagaacgaagauucggcaacucccuaaccugcugcgcggauacgagaaaaucagacucucuacacagaauguuauuaacgccgaaaaggcuccgggcggccccuaucggcuggggaccagcggauccugcccuaaugccacaagcaaaucuggcuucuuugcgaccauggccugggcugugccccgcgacaacaauaagaccgccacaaacccucuuacggucgaggugccccacaucuguaccaaggaagaggaucagauuacaguguggggguuccauuccgacaauaaaccgcagaugaagaaccuguacggagauagcaauccucaaaaauuuaccucuuccgcuaacggcaucacaacccacuaugucagccagauugggggauuccccgagcagacggaagacggcggccucccucagucugggagaaucguuguggauuacauggugcaaaagcccggaaaaacaggcaccaucgucuaucagcgggggauucugcuuccccagaagguguggugcgccuccggacgcagcaaaguuaucaagggcucccugccucucauuggggaggcggacugucugcacgaaaaguacggaggccugaauaaaucuaagccguauuacaccggcgagcaugccaaagcuaucgggaacugccccauuugggugaagacaccucucaaacuggccaacggaaccaaguacagacccccugcuaaacuucugaaggagcggggcuuuuucggggccaucgccggauuucucgaaggcgggugggagggcaugaucgcuggauggcacggcuauacaagccauggggcgcacggagucgccguggcugccgaucugaaguccacgcaggaagccauuaauaaaaucaccaagaaccuuaauagccugucugagcucgaaguuaaaaaccugcaacgccuguccggcgcuauggacgagcuccacaaugagauucuggaacuugaugagaagguggacgaccugagagccgauacaaucagcucucagauugaacucgcgguccugcuuagcaacgaggggaucaucaauuccgaagacgagcaucugcucgcucuggagcggaagcugaaaaagaugcucggacccucugccguggauauuggcaacggguguuucgaaaccaaacacaagugcaaucagacaugccuggaccgcaucgccgcuggcaccuuuaacgccggagaguucagccuuccgacguuugauucccugaauauuaccgcugccagccucaacgacgauggccuggacaaucauacaauccugcuuuacuauucuaccgcggccuccagccucgcugucacacugaugauugccaucuucauuguguacaugaucucuagagauaacguuuccuguagcaucugccuguga

SEQ ID NO: 209478 - RNA, 1758 nt, Artificial Sequence
  derived and/or modified sequence opt5 from hemagglutinin__InfluenzaB__ABL77068
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaaaaagcuccgggcggccccuauaagaucgggacgagcggauccugcccuaacgucacaaauggcaacggguucuuugccaccauggcuugggccgugcccaaaaaugagaacaauaagacagcgaccaacagccugaccauugaagugccuuacaucuguacagagggagaggaccagauuacggucuggggcuuccauucugauaacgaaaaucagauggccaaacuuuauggggacuccaagccccagaaguuuaccagcucugcuaacggaguuacaacccacuacgugucccaaaucggcggcuucccgaaucagacagaggaugggggacugccucagagcggcagaaucguggucgacuauauggugcagaaaucugggaagaccggaacgauuacauaccaacggggcauccuccugccccagaaaguuuggugcgccuccgggcgcagcaaggugauuaaaggaucccuuccucugaucggcgaagcugauugucuccacgagaaguauggcgggcugaacaagucuaaacccuacuacaccggagagcaugccaaggcgauuggcaauugccccaucugggucaaaaccccucugaagcucgccaacgggacaaaauauagaccgcccgcuaagcugcuuaaggaacggggauuuuucggcgccaucgcuggguuucuggagggcggaugggaaggcaugauugccggguggcacggauacaccagccauggcgcccacgggguggcuguugcggccgaccucaaauccacacaggaggcuaucaauaagauuacgaaaaaccugaauagccuuucugaacuggaggugaagaaccuccagcgccuguccggagccauggaugagcugcacaaugaaauccucgagcuggacgaaaaagucgaugaccuuagagccgacaccauuagcucucaaaucgagcuggcugugcuccugagcaacgaaggcaucauuaauuccgaggaugagcaucuucuggcccucgaacggaagcugaagaaaaugcuggggccuucugcggucgagaucggcaacggauguuucgaaacaaagcacaaaugcaaucagaccugccucgaccgcauugcugccggcacauuuaacgccggggaguucagccugcccaccuuugauucccuuaacaucacggcugccagccugaaugacgauggacucgacaaccauaccauucugcuguauuacucuacagcugccuccagccuugcggugacccucaugaucgccauuuucguuguguauauggucucuagagauaauguguccuguagcaucugccuguga

SEQ ID NO: 209479 - RNA, 1758 nt, Artificial Sequence
  derived and/or modified sequence opt5 from hemagglutinin__InfluenzaB__ABL77090
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacacuuaccaagucccauuucgcgaaucugaaaggcacgaagacccgggggaaacucuguccgaagugccugaacuguacagaucuugacguggcucugggacgccccaagugcaccggcaauauuccuucugccaaagucagcauccuccacgaagugagacccguuacauccggguguuuuccuaucaugcaugaucggaccaagauucgccaacugcccaaccugcucagaggauacgagcggauccgccugucuaaucacaacgugauuaaugccgaaaaagcuccuggcggcccguauaagaucgggacgagcggauccugccccaacgucacaaauggcaacggguucuuugccaccauggcuugggccgugccuaaaaaugagaacaauaagacagcgaccaacagccuuaccauugaagugcccuacaucuguacagagggagaggaccagauuacggucuggggcuuccauucugauaacgaaauccagaugguuaagcuguauggggacuccaaaccucagaaguuuaccagcucugccaauggagugacaacccacuacgugucccaaaucggcggcuuccccaaccagauugaggaugggggacucccgcagagcggcagaaucgucguggacuauaugguucagaaaucugggaagacaggaaccauuacguaccaacggggcauccugcuuccucagaaaguguggugcgcuuccgggcgcagcaagauuaucaaaggaucccugccccucaucggcgaagccgauugucugcacgagaaguauggcgggcugaauaagucuaaaccuuacuacacaggagagcaugcuaaggccauuggcaacugccccaucugggucaaaacaccccucaagcuggcgaaugggaccaaauauagaccuccggccaaacuucugaaggaacggggauuuuucggcgcuauugccggguuucucgagggcggaugggaaggcaugaucgcuggguggcacggauacacaagccauggcgcccacgggguggccguugcugcggaccugaaguccacccaggaggccauuaacaagaucaccaaaaaucuuaacagccugucugaacucgaggugaagaaucugcagcgccuguccggagcuauggaugagcuccacaacgaaauccuggagcuugacgaaaaagucgaugaccugagagccgacacgauuagcucucaaaucgagcucgccgugcugcuuagcaaugaaggcauuaucaacuccgaggaugagcaucugcucgcucuggaacggaagcugaagaaaaugcucgggcccucugccgucgagauuggcaauggauguuucgaaaccaagcacaaaugcaaccagacaugccuggaccgcaucgcggcuggcaccuuuaaugccggggaguucagccuuccuacauuugauucccugaacauuaccgccgcuagccucaacgacgauggacuggacaaucauacgauccugcuuuauuacucuaccgccgcuuccagccucgccgugacacugaugaucgcgauuuucguuguguauauggucucuagagauaacguguccuguagcaucugccuguga

SEQ ID NO: 209480 - RNA, 1755 nt, Artificial Sequence
  derived and/or modified sequence opt5 from hemagglutinin__InfluenzaB__ABL77101
augaaggccaucauugugcugcucauggucguuaccagcaaagcugacagaaucugcacaggcauuacguccucuaacagcccccacguggugaagaccgccacacagggggaggucaaugugaccggagcgaucccucugacaaccacaccgaccaaaucccauuucgcuaaccuuaagggcacgaaaacccgggggaagcugugucccacaugccucaauuguaccgaucuggacguugcccuuggacgcccuaugugcgugggcauuacacccucugccaaggcuagcauccugcacgaagucaaaccugugaccuccggguguuuucccaucaugcaugauagaacgaagauucggcaacucccuaaccugcugcgcggauacgagaaaaucagacucucuacacagaauguuauuaacgccgaaaaggcuccgggcggccccuaucggcuggggaccagcggauccugcccuaaugccacaagcaaaucuggcuucuuugcgaccauggccugggcugugccccgcgacaacaauaagaccgccacaaacccucuuacggucgaggugccccacaucuguaccaaggaagaggaucagauuacaguguggggguuccauuccgacgauaaaacccagaugaagaaucuguacggagacagcaacccgcaaaaauuuacaucuuccgcuaauggcaucaccacgcacuaugucagccagauugggggauucccugagcagacagaagauggcggccucccccagucugggagaaucguuguggacuacauggugcaaaagccuggaaaaaccggcaccaucgucuaucagcgggggauucugcuuccccagaagguguggugcgccuccggacgcagcaaaguuaucaagggcucccugccccucauuggggaggcggauugucugcacgaaaaguacggaggccugaacaaaucuaagccuuauuacacaggcgagcaugccaaagcuaucgggaauugcccgauuugggugaagacaccccucaaacuggccaacggaaccaaguacagaccucccgcuaaacuucugaaggagcggggcuuuuucggggccaucgccggauuucucgaaggcgggugggagggcaugaucgcuggauggcacggcuauacgagccauggggcgcacggagucgccguggcugccgaccugaaguccacccaggaagccauuaacaaaaucacaaagaaucuuaacagccugucugagcucgaaguuaaaaaucugcaacgccuguccggcgcuauggaugagcuccacaacgagauucuggaacuugacgagaagguggacgaucugagagccgacaccaucagcucucagauugaacucgcgguccugcuuagcaaugaggggaucaucaacuccgaagaugagcaucugcucgcucuggagcggaagcugaaaaagaugcucggaccuucugccguggacauuggcaauggguguuucgaaacaaaacacaagugcaaccagaccugccuggaucgcaucgccgcuggcacguuuaaugccggagaguucagccuucccaccuuugacucccugaacauuacagcugccagccucaaugaugacggccuggauaaccauaccauccugcuuuacuauucuacagcggccuccagccucgcugucacccugaugauugccaucuucauuguguacaugaucucuagagacaauguuuccuguagcaucugccuguga

SEQ ID NO: 209481 - RNA, 1758 nt, Artificial Sequence
  derived and/or modified sequence opt5 from hemagglutinin__InfluenzaB__ABL77134
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaaaaagcuccgggcggccccuauaagaucgggacgagcggauccugcccuaacgucacaaauggcaacggguucuuugccaccauggcuugggccgugcccaaaaaugagaacaauaagacagcgaccaacagccugaccauugaagugccuuacaucuguacagagggagaggaccagauuacggucuggggcuuccauucugauaacgaagcccagauggcuaaacuuuauggggacuccaagccccagaaguuuaccagcucugccaauggaguuacaacccacuacgugucccaaaucggcggcuucccgaaccagacagaggaugggggacugccucagagcggcagaaucguggucgacuauauggugcagaaaucugggaagaccggaacgauuacauaccaacggggcauccuccugccccagaaaguuuggugcgcuuccgggcgcagcaaggugauuaaaggaucccuuccucugaucggcgaagccgauugucuccacgagaaguauggcgggcugaauaagucuaaacccuacuacaccggagagcaugcgaaggccauuggcaacugccccaucugggucaaaaccccucugaagcucgcuaaugggacaaaauauagaccgcccgccaagcugcuuaaggaacggggauuuuucggcgcuaucgccggguuucuggagggcggaugggaaggcaugauugccggguggcacggauacaccagccauggcgcucacgggguggcgguugccgcugaccucaaauccacacaggaggccaucaacaagauuacgaaaaaucugaacagccuuucugaacuggaggugaagaaucuccagcgccuguccggagccauggaugagcugcacaacgaaauccucgagcuggacgaaaaagucgaugaccuuagagcugacaccauuagcucucaaaucgagcuggccgugcuccugagcaaugaaggcaucauuaacuccgaggaugagcaucuucuggcgcucgaacggaagcugaagaaaaugcuggggccuucugcugucgagaucggcaauggauguuucgaaacaaagcacaaaugcaaccagaccugccucgaccgcauugccgccggcacauuuaaugcuggggaguucagccugcccaccuuugauucccuuaacaucacggccgcuagccugaacgacgauggacucgacaaucauaccauucugcuguauuacgccacagcggccucuucccuugcugugacccucaugaucgccauuuucguuguguauauggucagcagagauaacgugucuuguuccaucugccuguga

SEQ ID NO: 209482 - RNA, 1758 nt, Artificial Sequence
  derived and/or modified sequence opt5 from hemagglutinin__InfluenzaB__ABL77145
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaagaggcuccgggcggccccuauaaaaucgggacgagcggauccugcccuaacgucacaaauggcaacggguucuuugccaccauggcuugggccgugcccaagaaugaaaacaauaaaacagcgaccaacagccugaccauugaggugccuuacaucuguacagagggagaagaccagauuacggucuggggcuuccauucugauuccgagacccagauggccaagcuguauggggacagcaagccccagaaauuuacaucuuccgcuaacggaguuaccacacacuacgugagccaaaucggcggcuucccgaaucagaccgaagaugggggacugccucagucuggcagaaucguggucgacuauauggugcagaaguccgggaaaacgggaacaauuaccuaccaacggggcauccuccugccccagaagguuuggugcgccagcgggcgcuccaaagugauuaagggaucucuuccucugaucggcgaggcugauugucuccacgagaaauauggcgggcugaacaagagcaagcccuacuacaccggagaacaugccaaagcgauuggcaauugccccaucugggucaagacaccucugaaacucgccaacgggaccaaguauagaccgcccgcuaaacugcuuaaggagcggggauuuuucggcgccaucgcuggguuucuggaaggcggaugggagggcaugauugccggguggcacggauacacaucccauggcgcccacgggguggcuguugcggccgaccucaagagcacgcaggaagcuaucaauaaaauuaccaagaaccuuaauucucuuuccgagcuggaggugaaaaaccuccagcgccugagcggagccauggaugaacugcacaaugagauccucgaacuggacgagaaggucgaugaccuuagagccgacacaauuucuagccaaaucgaacuggcugugcuccuguccaacgagggcaucauuaauucugaggaugaacaucuucuggcccucgagcggaaacugaagaagaugcuggggccuagcgcggucgaaaucggcaacggauguuucgagaccaaacacaagugcaaucagacaugccucgaccgcauugcugccggcaccuuuaacgccggggaguucucccugcccacguuugauagccuuaauaucaccgcugccucucugaacgacgauggacucgacaaccauacaauucugcuguauuacuccaccgcugccagcucucuugcggugacacucaugaucgccauuuucguuguguauauggucuccagagauaaugugagcuguuccaucugccuguga

SEQ ID NO: 209483 - RNA, 1755 nt, Artificial Sequence
  derived and/or modified sequence opt5 from hemagglutinin__InfluenzaB__ABL77156
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuaugucuguacggaaggggaggaucagauuaccguuuggggauuccauuccgacgauaagacacagaugaaaaaucuguacggcgacagcaacccgcaaaaguuuaccucuuccgccaauggggugacaacccacuaugugagccagaucggaggcuucccugaucagacggaggacggcgggcucccccagucuggacggauugucguggauuacaugguucaaaagccuggcaaaacagggaccaucguguaucagcgcggaguccugcuuccccagaagguguggugcgcuuccggcagaagcaaaguuauuaaggggucccugccccucaucggagaagccgacugucugcaugagaaauacggcggccugaacaagucuaaaccuuacuauaccggggaacacgcgaaggccaucggaaacugcccgauuugggugaagacaccccucaaacuggcuaauggcaccaaguaccggccucccgccaaacuucugaaggagcgcggguuuuucggagcuaucgccggcuuucucgaagggggcugggaaggaaugauugccggcuggcacggguauacaagccauggagcucacggcgucgcgguggccgcugaccugaaauccacgcaggaggccaucaacaagauuaccaagaaucuuaacagccugucugaacucgaggucaaaaaucugcaaagacuguccggggccauggaugaacuccauaacgagauccuggagcuugacgaaaagguggaugaccugcgggcugauacaaucagcucucagauugagcucgccguucugcuuagcaaugaaggaaucauuaacuccgaggacgaacaucugcucgcgcuggagcgcaaacugaagaaaaugcucggcccuucugcuguggauaucgggaauggcuguuucgagaccaagcacaagugcaaccagacaugccuggacagaauugccgccggaaccuuuaaugcuggcgaguucagccuucccacguuugauucccugaacaucaccgccgcuagccucaaugacgaugggcuggacaaccacacaauccugcuuuacuauucuaccgccgcguccagccucgccgucacacugaugcuggcuauuuucaucguguacaugguuucucgggacaauguguccuguagcauuugccucuga

SEQ ID NO: 209484 - RNA, 1758 nt, Artificial Sequence
  derived and/or modified sequence opt5 from hemagglutinin__InfluenzaB__ABL77178
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaaaaagcuccgggcggccccuauaagaucgggacgagcggauccugcccuaacgucacaaauggcaacggguucuuugccaccauggcuugggccgugcccaaaaaugagaacaauaagacagcgaccaacagccugaccauugaagugccuuacaucuguacagagggagaggaccagauuacggucuggggcuuccauucugauuccgaaacccagauggccaagcuguauggggacagcaaaccccagaaguuuacaucuuccgcuaacggaguuaccacacacuacgugagccaaaucggcggcuucccgaaucagaccgaggaugggggacugccucagucuggcagaaucguggucgacuauauggugcagaaauccgggaagacgggaacaauuaccuaccaacggggcauccuccugccccagaaaguuuggugcgccagcgggcgcuccaaggugauuaaaggaucucuuccucugaucggcgaagcugauugucuccacgagaaguauggcgggcugaacaagagcaaacccuacuacaccggagagcaugccaaggcgauuggcaauugccccaucugggucaaaacaccucugaagcucgccaacgggaccaaauauagaccgcccgcuaagcugcuuaaggaacggggauuuuucggcgccaucgcuggguuucuggagggcggaugggaaggcaugauugccggguggcacggauacacaucccauggcgcccacgggguggcuguugcggccgaccucaaaagcacgcaggaggcuaucaauaagauuaccaaaaaccuuaauucucuuuccgaacuggaggugaagaaccuccagcgccugagcggagccauggaugagcugcacaaugaaauccucgagcuggacgaaaaagucgaugaccuuagagccgacacaauuucuagccaaaucgagcuggcugugcuccuguccaacgaaggcaucauuaauucugaggaugagcaucuucuggcccucgaacggaagcugaagaaaaugcuggggccuagcgcggucgagaucggcaacggauguuucgaaaccaagcacaaaugcaaucagacaugccucgaccgcauugcugccggcaccuuuaacgccggggaguucucccugcccacguuugauagccuuaauaucaccgcugccucucugaacgacgauggacucgacaaccauacaauucugcuguauuacuccaccgcugccagcucucuugcggugacacucaugaucgccauuuucguuguguauauggucuccagagauaaugugagcuguuccaucugccuguga

SEQ ID NO: 209485 - RNA, 1755 nt, Artificial Sequence
  derived and/or modified sequence opt5 from hemagglutinin__InfluenzaB__ABL77189
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggcauuccuaugugcgucggaaccacacccucugccaaagccagcauccugcaugaagugagaccuguuaccuccggguguuuucccaucaugcacgaccggacgaagauucgccaacucccuaaucugcugagaggauaugagaacauccggcucucuacacagaaugugauugaugcugaaaaggccccgggcggccccuaccgccuggggaccagcggauccugcccuaacgcuacaagcaaaucuggcuucuuugccaccauggcgugggccguccccaaggacaauaacaaaaaugcuaccaacccucuuacaguggaggugcccuaugucuguacggaaggggaggaucagaucaccguuuggggauuccauuccgacaauaagauucagaugaaaaaccuguacggcgauagcaauccgcaaaaguuuacaucuuccgccaacggggugaccacacacuaugugagccagaucggaggcuucccugaccagaccgaggauggcgggcucccccagucuggaagaauugucguggacuacaugguucaaaagccuggcaaaacggggacaaucguguaucagcggggaguccugcuuccccagaagguguggugcgcuuccggccgcagcaaaguuaucaaggggucccugccccucauuggagaagccgauugucugcaugagaaauacggcggccugaacaagucuaaaccuuacuauaccggggaacacgcgaaggccaucggaaauugcccgauuugggugaagacaccccucaaacuggcuaacggcaccaaguacagaccucccgccaaacuucugaaggagcggggguuuuucggagcuaucgccggcuuucucgaagggggcugggaaggaaugauugccggcuggcacggguauaccagccauggagcucacggcgucgcgguggccgcugaccugaaauccacacaggaggccaucaauaagaucacgaagaaccuuaauagccugucugaacucgaggucaaaaaccugcaacgccuguccggggccauggacgaacuccauaaugagauucuggagcuugaugaaaagguggacgaucugagagcugacaccaucagcucucagauugagcucgccguucugcuuagcaacgaaggaaucauuaauuccgaggaugaacaucugcucgcgcuggagcggaaacugaagaaaaugcucggcccuucugcuguggacaucgggaacggcuguuucgagacaaagcacaagugcaaucagaccugccuggaucgcaucgccgccggaacauuuaacgcuggcgaguucagccuucccaccuuugacucccugaauauuacggccgcuagccucaacgaugacgggcuggauaaucacaccauccugcuuuacuauucuacagccgcguccagccucgccgucacccugaugcuggcuauuuucaucguguacaugguuucuagagacaacguguccuguagcauuugccucuga

SEQ ID NO: 209486 - RNA, 1758 nt, Artificial Sequence
  derived and/or modified sequence opt5 from hemagglutinin__InfluenzaB__ABL77200
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaugggcaauauucccucugccaaagucagcauccugcacgaagugagaccuguuaccuccggguguuuucccaucaugcaugaucggacaaagauucgccaacucccuaaccugcugagaggauacgagcacauccggcucucuacccauaaugugauuaacgccgaaaaagcuccgggcggccccuauaagaucgggacgagcggauccugcccuaaugucacaaacggcaauggguucuuugccaccauggcuugggccgugcccaaaaacgacaauaacaagacagcgaccaauagccugaccauugaggugccuuacaucuguacagaaggagaggaucagauuacggucuggggcuuccacucugacaacgagacccagauggccaaacuuuauggggauuccaagccccagaaguuuacaagcucugcuaacggaguuaccacacacuacgugucccaaaucggcggcuucccgaaucagaccgaagacgggggacugccucagagcggccgcaucguggucgauuauauggugcagaaaucugggaaggccggaacgauuacauaccaaagaggcauccuccugccccagaaaguuuggugcgcuuccgggcggagcaaggugauuaaaggaucccuuccucugaucggcgaggccgacugucuccaugaaaaguauggcgggcugaacaagucuaaacccuacuacaccggagagcacgcgaaggccauuggcaauugccccaucugggucaaaaccccucugaagcucgcuaacgggacaaaauaucgcccgcccgccaagcugcuuaaggagagaggauuuuucggcgcuaucgccggguuucuggaaggcggaugggagggcaugauugccggguggcauggauacaccagccacggcgcucacgggguggcgguugccgcugaucucaaauccacacaggaagccaucaauaagauuacgaaaaaccugaauagccuuucugagcuggaagugaagaaccuccagcggcuguccggagccauggacgagcugcauaaugagauccucgaacuggauggcaaagucgacgaccuucgcgcugauaccauuagcucucaaaucgagcuggccgugcuccugagcaacgaagggaucauuaauuccgaggacgaacaccuucuggcgcucgagagaaagcugaagaaaaugcugggcccuucugcugucgagaucggaaacggcuguuucgaaacaaagcauaaaugcaaucagaccugccucgaucggauugccgccgggacauuugacgcuggagaguucagccugcccaccuuugauucccuuaacaucacggccgcuagccugaaugacgauggccucgacaaccacaccauucugcuguauuacucuacagccgcguccagccuugccgugacccucaugaucgcuauuuucguuguguauauggucucucgcgauaacguguccuguagcaucugccuguga

SEQ ID NO: 209487 - RNA, 1755 nt, Artificial Sequence
  derived and/or modified sequence opt5 from hemagglutinin__InfluenzaB__ABL77222
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacagcaagacacagaugaaaaaucuguacggcgauucuaacccccaaaaguuuaccuccagcgcuaaugggguuacaacccacuaugugucucagauuggaggcuucccggaccagacggaggauggcgggcucccucaguccggacggaucguggucgacuacaugaugcaaaagcccggcaaaacagggaccauuguguaucagcgcggaguucugcuuccucagaagguguggugcgccagcggcagauccaaagucaucaaggggucucugccccucaucggagaagcggauugucugcaugagaaauacggcggccugaacaagagcaaacccuacuauaccggggaacacgccaaggcuauuggaaacugcccuaucugggugaagacaccgcucaaacuggccaauggcaccaaguaccggcccccugcuaaacuucugaaggagcgcggguuuuucggagccauugccggcuuucucgaagggggcugggaaggaaugaucgcuggcuggcacggguauacaucccauggagcgcacggcguugccguggcugccgaccugaaaagcacgcaggaggccauuaacaagaucaccaagaaucuuaacucucuguccgaacucgaggucaaaaaucugcaaagacugagcggggcuauggacgaacuccauaacgagauccuggagcuugaugaaaagguggacgaucugcgggccgacacaauuucuagccagaucgagcucgcgguccugcuuuccaaugaaggaauuaucaacucugaggaugaacaucugcucgcucuggagcgcaaacugaagaaaaugcucggccccagcgccguggacauugggaauggcuguuucgagaccaagcacaagugcaaccagacaugccuggauagaaucgccgcuggaaccuuuaaugccggcgaguucucccuuccuacguuugacagccugaacaucaccgcugccucucucaaugaugacgggcuggauaaccacacaauucugcuuuacuauuccaccgcggccagcucucucgcuguuacacugaugcuggccaucuucauuguguacauggucucccgggacaaugugagcuguuccaucugccucuga

SEQ ID NO: 209488 - RNA, 1758 nt, Artificial Sequence
  derived and/or modified sequence opt5 from hemagglutinin__InfluenzaB__ABL77233
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaagcccagauggcuaaacuuuauggggauuccaagccccagaaguuuacaagcucugccaacggagucaccacacacuacguuucccaaaucggcggcuucccgaaucagaccgaggacgggggacugccucagagcggccgcauugugguggauuauaugguccagaagucuagaaaaacggggacaaucaccuaccaacgggggauucuccugccccagaagguguggugcgcuuccggccgcagcaaaguuaucaaggggucccuuccucugauuggagaagccgacugucuccaugagaaauauggcggccugaacaagucuaagcccuacuacaccggggagcacgcgaaagccaucggaaauugccccaucugggugaagacaccucugaaacucgcuaacggcaccaaguauagaccgcccgccaaacugcuuaaggaacggggguuuuucggagcuauugccggcuuucuggagggaggcugggaaggaaugaucgccggcuggcauggguacacaagccacggagcucacggcgucgcgguggccgcugaucucaaguccacgcaggaggccauuaauaaaaucaccaagaaccugaauagccuuucugaacuggagguuaaaaaccuccagcgccuguccggggccauggacgagcugcauaaugaaauucucgagcuggaugaaaagguggacgaccuuagagcugauacaaucagcucucaaaucgagcuggccguccuccugagcaacgaaggaauuaucaauuccgaggacgagcaccuucuggcgcucgaacggaaacugaagaagaugcugggcccuucugcuguggagauugggaacggcuguuucgaaaccaaacauaagugcaaucagacaugccucgaucgcaucgccgccggaaccuuugacgcuggcgaguucagccugcccacguuugauucccuuaacauuaccgccgcuagccugaaugacgaugggcucgacaaccacacaauccugcuguauuacucuaccgccgcguccagccuugccgucacacucaugauugcuaucuucgugguuuauauggugucuagagauaacgucuccuguagcaucugccuguga

SEQ ID NO: 209489 - RNA, 1758 nt, Artificial Sequence
  derived and/or modified sequence opt5 from hemagglutinin__InfluenzaB__ABL77244
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcacaauucccucugccaaagccagcauccugcacgaagucaagccugugaccuccggguguuuucccaucaugcaugauagaacgaaaauucggcaacucccuaaucugcugcgcggauacgagcacaucagacucucuacacauaacguuauuaaugcugaaaccgccccgggcggccccuauaagguggggacaagcggauccugcccuaacgucaccaauggcaacggguucuuugcuaccauggccugggcggugcccaaaaaugacaacaauaagacagccacgaacccucugaccguggagguccccuacaucuguacagaaggagaggaucagauuaccguuuggggcuuccacagcgacaaugaggcucagauggugaaacuuuauggggauucuaagccgcagaaguuuacauccagcgccaacggagugaccacgcacuacgucucucaaaucggcggcuucccuaaccaggcugaagacgggggacugccccaguccggccggauugugguugauuauauggugcagaaaagcgggaagacaggaaccaucaccuaccaacgcggcauccuccugccucagaaagucuggugcgccucugggagauccaaggugauuaaaggaagccuuccccugaucggcgaggcggacugucuccaugaaaaguauggcgggcugaauaaguccaaacccuacuacacaggagagcacgccaaggcuauuggcaacugcccuaucuggguuaaaaccccgcugaagcucgccaaugggacaaaauaucggcccccugcuaagcugcuuaaggagaaaggauuuuucggcgccauugccggguuucuggaaggcggaugggagggcaugaucgcuggguggcauggauacacgucucacggcgcgcacgggguggccgucgcugccgaucucaagagcacccaggaagccaucaacaaaauuacaaagaaucugaacucccuuagcgagcuggaagugaaaaaucuccagcgccugucuggagcuauggacgagcugcauaacaagauccucgagcuggaugaaaaggucgacgaccuuagagccgauaccauuuccagccaaaucgagcuggcggugcuccugucuaaugaaggcauuaucaacagcgaggacgaacaccuucuggcucucgagcggaaacugaagaaaaugcuggggcccuccgccguugagaucggcaauggauguuucgaaacaaagcauaaaugcaaccagaccugccucgaucgcauugccgcuggcacguuuaaugccggggaguucucucugccuaccuuugacagccuuaacaucacagcugccucccugaaugaugacggacucgauaaccacaccauucugcuguauuacagcacagcggccucuucccuugcugugacccucaugaucgccauuuucaucgucuauauggugagcagagacaacguuucuuguuccauuugccuguga

SEQ ID NO: 209490 - RNA, 1752 nt, Artificial Sequence
  derived and/or modified sequence opt5 from hemagglutinin__InfluenzaB__ABL77255
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcaugggcaccauucccucugccaaggccagcauccugcacgaagucagaccugugacauccggguguuuucccaucaugcaugaucggaccaagauucgccaacucccuaaccugcugagaggauacgagaauauccggcucucuacgcacaacguuauuaaugcugaacgcgccccgggcggccccuauagacuggggacaagcggauccugcccuaacgugaccagccggaauggcuucuuugcuacaauggccugggcggucccccgcgacaacaaaaccgccaccaauccucuuacaguggaggugcccuacaucuguacgaagggggaagaucagauuaccgucuggggauuccauucugacgauaaaacacagaugaagaaccuguauggcgacuccaauccgcagaaauuuaccagcucugcuaacgggguuacaacccacuacgugucccaaaucggagauuucccuaaccagacggaggacggcggccucccccagagcgggagaauuguggucgauuauauggugcagaagccuggaaagacaggcaccaucguuuaccaacgcggggugcugcuuccccagaaagucuggugcgccucuggacgguccaaggugaucaaaggcagccugccccucauuggggaggcugacugucugcacgaaaaguauggaggccugaauaaauccaagccuuacuacaccggcgagcaugccaaagcgaucgggaacugcccgauuuggguuaagacaccccucaagcuggccaauggaaccaaauauagaccucccgcuaagcugcugaaagaacggggcuuuuucggggccaucgcuggauuucucgagggcgggugggagggcaugauugccggauggcacggcuacacaucucauggggcccacggaguggcugucgcggccgaucuuaagagcacgcaggaagcuaucaacaaaaucaccaagaaucuuaacucccugagcgagcucgaagugaagaaucugcagcgccugucuggcgccauggacgagcuccacaacgaaauucuggagcuugacgagaaagucgaugaccugagagccgauacaaucuccagccaaauugaacucgcugugcugcuuucuaaugaggggaucauuaacagcgaagacgagcaucugcucgcccuggaacggaagcugaaaaagaugcucggaccuuccgcgguugauaucggcaauggguguuucgagaccaaacacaagugcaaccagacaugccuggacagaaucgcugccggcaccuuuaaugccggagaguucucucuucccacguuugauagccugaacauuaccgcugccucccucaaugacgauggccuggacaaccauacaauccugcuuuauuacagcaccgcugccucuucccucgcggugacacugaugauugccaucuucauugucuauauggugagccgcgauaacguuucuuguuccaucugccuguga

SEQ ID NO: 209491 - RNA, 1752 nt, Artificial Sequence
  derived and/or modified sequence opt5 from hemagglutinin__InfluenzaB__ABL77266
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaacgcgccccgggcggccccuauagacuggggaccagcggauccugcccuaacgucacaagccgggacggcuucuuugcuaccauggccugggcggugccccgcgauaauaaaaccgccacaaacccucuuacgguggagguccccuacauuuguaccaagggggaagaccagaucacaguuuggggauuccacucugauuccaaaacccagaugaagaaucuguauggcgacagcaacccgcaaaaauuuacaucuuccgcuaauggggugaccacgcauuacgugagccagauuggaggcuucccuaaccagacagaggauggcgggcucccccagucuggaagaaucgucguggacuauaugguucaaaagccuggcaagaccgggaccauuguguaccagcggggaguccugcuuccccagaaaguguggugcgccuccggccgcagcaagguuaucaaagggucccugccccucaucggagaggcugauugucugcacgaaaaguauggcggccugaacaaaucuaagccuuacuacacaggggagcacgccaaagcgauuggaaauugcccgaucugggugaagacaccccucaagcuggccaacggcaccaaauauagaccucccgcuaagcugcugaaagaacggggguuuuucggagccauugcuggcuuucucgaagggggcugggagggaaugaucgccggcuggcauggguacacgagccacggagcccauggcgucgcuguggcggccgaccugaaguccacccaggaggcuauuaauaaaaucacaaagaaccuuaauagccugucugagcucgaagucaagaaccugcaacgccuguccggggccauggaugagcuccacaaugaaauccuggagcuugacgagaaaguggacgaucugagagccgacaccauuagcucucagaucgaacucgcuguucugcuuagcaacgagggaauuaucaauuccgaagaugagcaccuucucgcccuggaacggaagcugaaaaagaugcucggcccuucugcgguggacauugggaacggcuguuucgagacaaaacauaagugcaaucagaccugccuggauagaaucgcugccggaacguuuaacgccggcgaguucagccuucccaccuuugacucccugaauaucacagcugccagccucaacgaugacgggcuggauaaucacaccauucugcuuuauuacucuacagcugccuccagccucgcggucacccugaugaucgccauuuucaucguguauaugguuucucgcgacaacguguccuguagcauuugccuguga

SEQ ID NO: 209492 - RNA, 1752 nt, Artificial Sequence
  derived and/or modified sequence opt5 from hemagglutinin__InfluenzaB__ABL77277
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaacacccccucugccaaggccagcauucugcacgaagugagaccuguuacauccggguguuuucccaucaugcaugaucggaccaagauccgccaacucccuaaucugcugagaggauacgagaacauucggcucucuacgcagaaugugaucaacgcugaacgcgccccgggcggccccuauagacuggggacaagcggauccugcccuaaugucaccaaccgggacggcuucuuugcuacaauggccugggcggugccccgcgauaauaaaaccgccaccaacccucuuacaguggagguccccuacauuuguacgaagggggaagaccagaucaccguuuggggauuccacagcgauaauaaaauucagaugaagaaccuguauggcgacucuaacccgcaaaaauuuacauccagcgcuaauggggugaccacacauuacgugucucagaucggaggcuucccuaaccagaccgaggauggcgggcucccccaguccggaagaauugucguggacuauaugguucaaaagccuggcaagacggggacaaucguguaccagcggggaguccugcuuccccagaaaguguggugcgccagcggccgcucuaagguuaucaaagggucccugccccucauuggagaggcugauugucugcacgaaaaguauggcggccugaauaaaagcaagccuuacuacaccggggagcacgccaaagcgaucggaaacugcccgauuugggugaagacaccccucaagcuggccaauggcaccaaauauagaccucccgcuaagcugcugaaagaacggggguuuuucggagccaucgcuggcuuucucgaagggggcugggagggaaugauugccggcuggcauggguacaccucccacggagcccauggcgucgcuguggcggccgaccugaagucuacacaggaggcuaucaacaaaaucacgaagaaucuuaacagccuguccgagcucgaagucaagaaucugcaacgccugagcggggccauggaugagcuccacaacgaaauucuggagcuugacgagaaaguggacgaucugagagccgacaccaucucuucccagauugaacucgcuguucugcuuagcaaugagggaaucauuaacucugaagaugagcaccuucucgcccuggaacggaagcugaaaaagaugcucggcccuagcgcgguggacaucgggaauggcuguuucgagacaaaacauaagugcaaccagaccugccuggauagaaucgcugccggaacauuuaaugccggcgaguucucccuucccaccuuugacucucugaacauuacggcugccagccucaacgaugacgggcuggauaaucacaccauccugcuuuauuacuccacagcugccagcucucucgcggucacccugaugauugccaucuucauuguguauaugguuucccgcgacaacgugagcuguucuaucugccuguga

SEQ ID NO: 209493 - RNA, 1752 nt, Artificial Sequence
  derived and/or modified sequence opt5 from hemagglutinin__InfluenzaB__ABL77288
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagcacauucggcucucuacacagaaugugaucaacgcugaaaaagccccgggcggccccuauaagcuggggaccagcggauccugcccuaaugcuacaagccgcucuggcuucuuugccaccauggcgugggccguccccagagacaacaaaaccgcuacaaauccucuuacgguggaggugcccuacauuuguaccaagggggaagaucagaucacagucuggggauuccauuccgacaccaaaacacagaugaagaaccuguauggcgauagcaauccgcaaaaguuuaccucuuccgccaacgggguuacgacacacuacgugagccagauuggaggcuucccugaccagaccgaggauggcgggcucccccagucuggacggaucguggucgacuauauggugcaaaaaccuggcaagaccgggacaauuguuuaccagcgcggagugcugcuuccccagaaagucuggugcgcuuccggcagaagcaaggugaucaaagggucccugccccucaucggagaggccgauugucugcacgaaaaguauggcggccugaauaaaucuaagccuuacuacaccggggagcaugcgaaggccauuggaaacugcccgaucuggguuaaaacaccccucaagcuggcuaacggcacgaaauaucggccucccgccaaacuucugaaggaacgcggguuuuucggagcuauugccggcuuucucgaagggggcugggagggaaugaucgccggcuggcacggguacaccagccauggagcucacggcguggcggucgccgcugaccugaaguccacacaggaggccauuaauaagaucaccaaaaaccuuaauagccugucugagcucgaagugaagaaccugcaaagacuguccggggccauggaugagcuccacaaugaaauccuggagcuugacgagaaagucgacgaucugcgggcugacacaauuagcucucagaucgaacucgccgugcugcuuagcaacgagggaauuaucaauuccgaagaugagcaucugcucgcgcuggaacgcaagcugaaaaagaugcucggcccuucugcuguugacauugggaacggcuguuucgagaccaagcacaaaugcaaucagacgugccuggauagaaucgccgccggaaccuuuaacgcuggcgaguucagccuucccacauuugacucccugaauaucaccgccgcuagccucaacgaugacgggcuggauaaucauacaauucugcuuuauuacucuaccgccgcguccagccucgccgugacgcugaugaucgcuauuuucaucgucuauauggugucucgggacaacguuuccuguagcauuugccuguga

SEQ ID NO: 209494 - RNA, 1752 nt, Artificial Sequence
  derived and/or modified sequence opt5 from hemagglutinin__InfluenzaB__ABL77299
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaacauccccucugccaaggccagcauccugcacgaagucagaccugugaccuccggguguuuucccauuaugcaugaucggacaaagauccgccaacucccuaaucugcugagaggauacgagcacauucggcucucuacccauaacguuaucaaugcugaacgcgccccgggcggccccuauagacuggggacgagcggauccugcccuaacgugacaagccggucuggcuucuuugcuaccauggccugggcggucccccgcgacaauaaaacagccaccaacccucuuaccguggaggugcccuacauuuguacaaagggggaagaucagaucacggucuggggauuccacuccgacaaugagacccagaugaaaaaccuguauggcgauagcaauccgcagaaguuuacaucuuccgcuaacgggauuaccacacacuacguuagccaaaucggaggcuucccuaaccagaccgaggacggcgggcucccccagucuggaagaaucgugguggauuauaugguccagaaaccuggcaagacggggacaauuguguaccaacggggaguucugcuuccccagaagguguggugcgccuccggccgcagcaaagucaucaaggggucccugccccucauuggagaagcugacugucugcaugagaaauauggcggccugaauaagucuaaaccuuacuacaccggggaacacgccaaggcgaucggaaacugcccgauuugggugaaaacaccccucaagcuggccaauggcaccaaguauagaccucccgcuaaacuucugaaggagcggggguuuuucggagccaucgcuggcuuucucgaagggggcugggaaggaaugaucgccggcuggcauggguacaccagccacggagcccacggcguugcuguggcggccgaucugaaauccacacaggaggcuauuaacaagaucacgaaaaaucuuaacagccugucugaacucgaggucaagaaucugcagcgccuguccggggccauggacgaacuccauaacgagauucuggagcuugaugaaaagguggacgaccugagagccgauaccaucagcucucaaauugagcucgcuguccugcuuagcaaugaaggaaucaucaacuccgaggacgaacaucugcucgcccuggagcggaaacugaagaaaaugcucggcccuucugcgguggauauugggaauggcuguuucgagacaaagcacaaaugcaaccagaccugccuggacagaaucgcugccggaacauuuaaugccggcgaguucagccuucccaccuuugauucccugaacauuacggcugccagccucaaugacgaugggcuggacaaccacaccauccugcuuuauuacucuacagcugccuccagccucgcgguuacccugaugauugccaucuucauuguguauauggucucucgcgauaacguguccuguagcaucugccuguga

SEQ ID NO: 209495 - RNA, 1752 nt, Artificial Sequence
  derived and/or modified sequence opt5 from hemagglutinin__InfluenzaB__ABL77310
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacaacaaaaaucagaugaagaaccuguauggcgauagcaauccgcagaaauuuacaucuuccgcuaacgggguuaccacacacuacgugagccaaauuggaggcuucccuaaccagaccgaggacggcgggcucccccagucuggaagaaucguggucgauuauauggugcagaagccuggcaagacggggacaaucguuuaccaacggggagugcugcuuccccagaaagucuggugcguguccggccgcagcaagguuauuaaagggucccugccccucaucggagaggccgacugucugcaugaaaaguauggcggccugaauaaaucuaagccuuacuacaccggggagcacgcuaaagccauuggaaacugcccgaucugggugaagacaccccucaagcuggcgaauggcaccaaauauagaccucccgccaagcugcugaaagaacggggguuuuucggagcuauugccggcuuucucgaagggggcugggagggaaugaucgcuggcuggcauggguacaccagccacggagcccacggcgucgccguggcugcggaucugaaguccacacaggaggccaucaacaaaauuacgaagaaucuuaacagccugucugagcucgaagucaagaaucugcagcgccuguccggggcuauggacgagcuccauaacgaaauccuggagcuugaugagaaaguggacgaccugagagccgauaccauuagcucucaaaucgaacucgccguucugcuuagcaaugagggaauuaucaacuccgaagacgagcaccuucucgcucuggaacggaagcugaaaaagaugcucggcccuucugccguggauaucgggaauggcuguuucgagacaaaacauaagugcaaccagaccugccuggacagaauugcggcuggaacauuuaaugccggcgaguucagccuucccaccuuugauucccugaacaucacggccgcuagccucaaugacgaugggcuggacaaccacaccauucugcuuuauuacucuacagccgcuuccagccucgccgucacccugaugaucgcgauuuucaucguguauaugguuucucgcgauaacguguccuguagcauuugccuguga

SEQ ID NO: 209496 - RNA, 1758 nt, Artificial Sequence
  derived and/or modified sequence opt5 from hemagglutinin__InfluenzaB__ABL77321
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcacaauucccucugccaaagucagcauccugcacgaagugaagccuguuaccuccggguguuuucccaucaugcaugauagaacgaaaauucggcaacucccuaaucugcugcgcggauacgagcacaucagacucucuacacauaacgugauuaaugccgaaaaggcuccgggcggccccuauaaaaucgggaccagcggauccugcccuaacauuacaaauggcaacggguucuuugccaccauggcuugggccguccccaagaaugacaacaauaagaccgcgacaaacagccugacgguggaggugccuuacaucuguaccgaaggagaggaucagauuacagucuggggcuuccacucugacaaugagacccagauggccaaacuuuauggggauuccaagccccagaaauuuacaagcucugcuaacggaguuaccacgcacuacgugucccaaaucggcggcuucccgaaccaggccgaagacgggggacugccucagagcggccggaucguggucgauuauauggugcagaagucugggaaaacaggaaccauuaccuaccaacgcggcauccuccugccccagaagguuuggugcgcuuccgggagaagcaaagugauuaagggaucccuuccucugaucggcgaggccgacugucuccaugaaaaguauggcgggcugaauaaaucuaagcccuacuacacaggagagcacgcgaaagccauuggcaacugccccaucugggucaagaccccucugaaucucgcuaacgggacaaaauaucggccgcccgccaagcugcuuaaggagcgcggauuuuucggcgcuaucgccggguuucuggaaggcggaugggagggcaugauugccggguggcauggauacacgagccacggcgcucacgggguggcgguugccgcugaucucaaauccacccaggaagccaucaauaagauuaccaaaaaccugaauagccuuucugagcuggaagugaagaaccuccagagacuguccggagccauggacgagcugcauaaugagauccucgaacuggaugagaaagucgacgaccuucgggcugauacaauuagcucucaaaucgaacuggccgugcuccugagcaacgagggcaucauuaauuccgaagacgagcaccuucuggcgcucgagcgcaagcugaagaaaaugcuggggccuucugcugucgaaaucggcaacggauguuucgagacaaagcauaaaugcaaucagaccugccucgauagaauugccgccggcacguuuaacgcuggggaguucagccugcccaccuuugacucccuuaauaucacagccgcuagccugaacgaugacggacucgauaaccacaccauucugcuguauuacucuacagccgcguccagccuugccgugacccucaugaucgcuauuuucaucguuuauauggugucucgggacaaugucuccuguagcaucugccuguga

SEQ ID NO: 209497 - RNA, 1755 nt, Artificial Sequence
  derived and/or modified sequence opt5 from hemagglutinin__InfluenzaB__ABL77332
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuauaagcuggggaccagcggauccugcccuaacgcuacaagccgcucuggcuucuuugccaccauggcgugggccguccccagagacaauaacaaaaccgcuacaaauccucuuacgguggaggugcccuacauuuguaccaagggggaagaucagaucacagucuggggauuccacuccgacgauaaaacccagaugaagaaccuguauggcgacagcaauccgcaaaaguuuacaucuuccgccaacgggguuaccacgcauuacgugagccagauuggaggcuucccugaucagacagaggacggcgggcucccccagucuggacggaucguggucgauuauauggugcaaaaaccuggcaagaccgggaccauuguuuaccagcgcggagugcugcuuccccagaaagucuggugcgcuuccggcagaagcaaggugaucaaagggucccugccccucaucggagaggccgacugucugcacgaaaaguauggcggccugaacaaaucuaagccuuacuacacaggggagcacgcgaaggccauuggaaauugcccgaucuggguuaaaacaccccucaagcuggcuaacggcacaaaauaucggccucccgccaagcugcugaaagaacgcggguuuuucggagcuauugccggcuuucucgaagggggcugggagggaaugaucgccggcuggcauggguacacgagccacggagcucauggcguggcggucgccgcugaucugaaguccacccaggaggccauuaauaagaucaccaaaaaccuuaauagccugucugagcucgaagugaagaaccugcaaagacuguccggggccauggacgagcuccacaaugaaauccuggagcuugacgagaaagucgaugaccugcgggcugauaccauuagcucucagaucgaacucgccgugcugcuuagcaacgagggaauuaucaauuccgaagacgagcaccuucucgcgcuggaacgcaagcugaaaaagaugcucggcccuucugcuguugauauugggaacggcuguuucgagacaaagcauaaaugcaaucagaccugccuggacagaaucgccgccggaacguuuaacgcuggcgaguucagccuucccaccuuugauucccugaauaucacagccgcuagccucaacgacgaugggcuggacaaucacgccauucugcuuuauuacucuaccgcggccuccagccucgcugugacacugaugaucgccauuuucaucgucuauauggugucucgggauaacguuuccuguagcauuugccuguga

SEQ ID NO: 209498 - RNA, 1755 nt, Artificial Sequence
  derived and/or modified sequence opt5 from hemagglutinin__InfluenzaB__ABL77343
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuaucgccuggggaccagcggauccugcccuaacgcuacaagcagaucuggcuucuuugccaccauggcgugggccgucccccgggacaauaacaagaccgcuacaaauccucuuacgguggaggugcccuacauuuguaccaaaggggaagaucagaucacagucuggggauuccacuccgacaacaagauucagaugaaaaaucuguauggcgauagcaacccgcaaaaguuuaccucuuccgccaacgggguuacaacccauuacgugagccagaucggaggcuucccugaccagacggaggauggcgggcucccccagucuggacgcauuguggucgacuauauggugcaaaagccuggcaaaacagggaccaucguuuaccagagaggagugcugcuuccccagaaggucuggugcgcuuccggccggagcaaagugguuaaggggucccugccccucaucggagaggccgauugucugcacgaaaaauauggcggccugaauaagucuaaaccuuacuacaccggggagcacgcgaaggccauuggaaacugcccgaucugggugaagacaccccucaaacuggcuaauggcaccaaguaucgcccucccgccaaacuucugaaggaaagaggguuuuucggagcuauugccggcuuucucgaagggggcugggagggaaugaucgccggcuggcauggguacacaagccacggagcucauggcgucgcgguggccgcugaccugaaauccacgcaggaggccauuaacaagaucaccaagaaucuuaacagccugucugagcucgaagucaaaaaucugcaacggcuguccggggccauggaugagcuccacaacgaaauccuggagcuugacgagaagguggacgaucugcgcgcugacacaauuagcucucagaucgaacucgccguucugcuuagcaaugagggaauuaucaacuccgaagaugagcaucugcucgcgcuggaaagaaaacugaagaaaaugcucggcccuucugcuguggacauugggaauggcuguuucgagaccaagcacaagugcaaccagacaugccuggaucggaucgccgccggaaccuuuaaugcuggcgaguucagccuucccacguuugacucccugaacaucaccgccgcuagccucaaugaugacgggcuggauaaccacacaauucugcuuuauuacucuaccgccgcguccagccucgccgucacacugaugaucgcuauuuucaucguguauaugguuucuagagacaacguguccuguagcauuugccuguga

SEQ ID NO: 209499 - RNA, 1755 nt, Artificial Sequence
  derived and/or modified sequence opt5 from hemagglutinin__InfluenzaB__ABL77365
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuaucgccuggggaccagcggauccugcccuaacgcuacaagcagaucuggcuucuuugccaccauggcgugggccgucccccgggacaauaacaagaccgcuacaaauccucuuacgguggaggugcccuacgucuguaccgaaggggaggaucagauuacaguuuggggauuccacuccgacaacaaaacccagaugaagaaucuguauggcgauagcaacccgcaaaaauuuacaucuuccgccaacggggugaccacgcauuacgugagccagaucggaggcuucccugaccaggcugaggauggcgggcucccccagucuggacgcauugucguggacuauaugguucaaaagccuggcaagacagggaccaucguguaccagagaggaguccugcuuccccagaaaguguggugcgccuccggccggagcaagguuauuaaagggucccugccccucaucggagaagcggauugucugcacgagaaguauggcggccugaauaaaucuaagccuuacuacaccggggaacacgccaaagcuaucggaaacugcccgauuugggugaagacaccccucaagcuggccaauggcaccaaauaucgcccucccgcuaagcugcugaaagagagaggguuuuucggagccaucgccggcuuucucgaagggggcugggaaggaaugauugcuggcuggcauggguacacaagccacggagcgcauggcgucgccguggcugccgaccugaaguccacgcaggaggccaucaacaaaauuaccaagaaucuuaacagccugucugaacucgaggucaagaaucugcaacggcuguccggggcuauggaugaacuccacaacgagauccuggagcuugacgaaaaaguggacgaucugcgcgccgacacaaucagcucucagauugagcucgcgguucugcuuagcaaugaaggaaucauuaacuccgaggaugaacaccuucucgcucuggagagaaagcugaaaaagaugcucggcccuucugccguggacaucgggaauggcuguuucgagaccaaacauaagugcaaccagacaugccuggaucggauugccgcuggaaccuuuaaugccggcgaguucagccuucccacguuugacucccugaacaucaccgcugccagccucaaugaugacgggcuggauaaccacacaauccugcuuuauuacucuaccgcggccuccagccucgcugucacacugaugauugccaucuucauuguguauaugguuucuagagacaacguguccuguagcaucugccuguga

SEQ ID NO: 209500 - RNA, 1755 nt, Artificial Sequence
  derived and/or modified sequence opt5 from hemagglutinin__InfluenzaB__ABL84340
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacacaaccagcaaaucuggcuucuuugcuaccauggccugggcgguccccagagacaauaacaagacagccacgaauccucuuaccguggaggugccccacaucuguacaaaagaagaggaucagauuaccgucuggggguuccauuccgacaacaagacacagaugaagaaucuguacggagauagcaacccgcaaaaauuuaccucuuccgcuaauggcguuacgacacacuaugugagccagaucgggggauucccugaccagaccgaggauggcggccucccccagucugggcggauuguggucgacuacauggugcaaaagccuggaaaaaccggcacaaucguuuaucagcgcgggauccugcuuccccagaagguguggugcgccuccggaagaagcaaagucauuaagggcucccugccccucaucggggaagcugauugucugcacgagaaauacggaggccugaacaagucuaagccuuauuacaccggcgaacaugccaaagcgauugggaacugcccgaucugggugaagacaccccucaaacuggccaauggaacgaaguaccggccucccgcuaaacuucugaaggagcgcggcuuuuucggggccauugcuggauuucucgagggcgggugggaaggcaugaucgccggauggcacggcuauaccagccauggggcccacggaguugcuguggcggccgaccugaaguccacacaggaggcuaucaacaaaauuaccaagaaucuuaacagccugucugaacucgaggucaaaaaucugcaaagacuguccggcgccauggaugaacuccacaacgagauccuggagcuugacgaaaagguggacgaucugcgggccgacacaauuagcucucagaucgagcucgcuguccugcuuagcaaugaagggauuaucaacuccgaggaugaacaucugcucgcccuggagcgcaaacugaagaagaugcucggaccuucugcgguggacaucggcaauggguguuucgagaccaaacacaagugcaaccagacgugccuggauagaauugcugccggcaccuuuaaugccggagaguucagccuucccacauuugacucccugaacaucaccgcugccagccucaauggcgaugggcuggacaaccauacaauucugcuuuacuauucuaccgcugccuccagccucgcgguuacgcugaugaucgccauuuucaucguguacaugauuucucgggauaaugucuccuguagcaucugccuguga

SEQ ID NO: 209501 - RNA, 1755 nt, Artificial Sequence; identical to SEQ ID NO: 209422
  derived and/or modified sequence opt5 from hemagglutinin__InfluenzaB__ABN50382

SEQ ID NO: 209502 - RNA, 1755 nt, Artificial Sequence; identical to SEQ ID NO: 209422
  derived and/or modified sequence opt5 from hemagglutinin__InfluenzaB__ABN50393

SEQ ID NO: 209503 - RNA, 1755 nt, Artificial Sequence
  derived and/or modified sequence opt5 from hemagglutinin__InfluenzaB__ABN50404
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugccccgggacaauaacaaaaccgcuacaaauccucuuacgguggaggucccccacauuuguaccaaggaagaggaucagaucacaguuuggggguuccauuccgacaacaaaacccagaugaagaaucuguacggagauagcaacccgcaaaaguuuacaucuuccgccaauggcgugaccacgcacuaugugagccagauugggggauucccugaccagacagaggauggcggccucccccagucugggcgcaucgucguggacuacaugguucaaaaaccuggaaagaccggcaccauuguguaucagagagggauccugcuuccccagaaagucuggugcgcuuccggacggagcaaggugaucaaaggcucccugccccucauuggggaagccgauugucugcacgagaaguacggaggccugaacaaaucuaagccuuauuacacaggcgaacaugcgaaggccaucgggaacugcccgauuuggguuaaaacaccccucaagcuggcuaauggaacaaaauaccgcccucccgccaaacuucugaaggagagaggcuuuuucggggcuaucgccggauuucucgagggcgggugggaaggcaugauugccggauggcacggcuauacgagccauggggcucacggaguggcggucgccgcugaccugaaguccacccaggaggccaucaacaagaucaccaaaaaucuuaacagccugucugaacucgaggugaagaaucugcaacggcuguccggcgccauggaugaacuccacaacgagauucuggagcuugacgaaaaagucgacgaucugcgcgcugacaccaucagcucucagauugagcucgccgugcugcuuagcaaugaagggaucauuaacuccgaggaugaacaucugcucgcgcuggagagaaagcugaaaaagaugcucggaccuucugcuguugacaucggcaauggguguuucgagacaaagcacaaaugcaaccagaccugccuggaucggaucgccgccggcacguuuaaugcuggagaguucagccuucccaccuuugacucccugaacauuacagccgcuagccucaaugaugacggccuggauaaccauaccauccugcuuuacuauucuacagccgcguccagccucgccgugacccugaugauugcuaucuucauugucuacaugaucucuagagacaauguguccuguagcauuugccuguga

SEQ ID NO: 209504 - RNA, 1755 nt, Artificial Sequence; identical to SEQ ID NO: 209431
  derived and/or modified sequence opt5 from hemagglutinin__InfluenzaB__ABN50415

SEQ ID NO: 209505 - RNA, 1755 nt, Artificial Sequence; identical to SEQ ID NO: 209431
  derived and/or modified sequence opt5 from hemagglutinin__InfluenzaB__ABN50426

SEQ ID NO: 209506 - RNA, 1755 nt, Artificial Sequence
  derived and/or modified sequence opt5 from hemagglutinin__InfluenzaB__ABN50437
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauccgaauccucaaaaguuuaccagcucugccaacgggguuacaacccacuaugugucccagauuggaggcuuccccgaccagacggaggauggcgggcucccucagagcggacggaucguggucgacuacaugaugcaaaagcccggcaaaacagggaccauuguguaucagcgcggaguucugcuuccccagaagguguggugcgcuucuggcaaauccaaggucaucaaagggagccugccucucaucggagaagccgauugucugcaugagaaguacggcggccugaacaaauccaagccguacuauaccggggaacacgcgaaggccauuggaaauugccccaucugggugaaaacaccucucaagcuggcuaacggcaccaaauacagacccccugccaagcugcugaaagagcggggguuuuucggagcuauugccggcuuucucgaagggggcugggaaggaaugaucgccggcuggcacggguauacaucucauggagcucacggcguugcgguggccgcugaccuuaagagcacgcaggaggccauuaauaagaucaccaaaaaccuuaauucccugagcgaacucgaggucaagaaccugcaacgccugucuggggccauggacgaacuccauaaugagauccuggagcuugaugaaaaaguggacgaucugagagcugacacaauuuccagccagaucgagcucgccguccugcuuucuaacgaaggaauuaucaauagcgaggaugaacaucugcucgcgcuggagcggaagcugaaaaagaugcucggccccuccgcuguggacauugggaacggcuguuucgagaccaagcacaaaugcaaucagacaugccuggaucgcaucgccgccggaaccuuuaacgcuggcgaguucucucuuccgacguuugacagccugaauaucaccgccgcuucccucaacgaugacgggcuggauaaucacacaauucugcuuuacuauagcaccgccgcgucuucccucgccguuacacugaugcuggcuaucuucauuguguacauggucagcagagacaacgugucuuguuccaucugccucuga

SEQ ID NO: 209507 - RNA, 1758 nt, Artificial Sequence
  derived and/or modified sequence opt5 from hemagglutinin__InfluenzaB__ABN50459
augaaggcccugaucgugcuccugauggucguuaccagcaacgcugacagaauuugcacaggcaucacguccucuaauagcccccacguggugaaaaccgccacacagggggaggucaacgugaccggaguuauuccucuuacaaccacaccgaccaagucccauuucgcgaaucugaaaggcacgaagacccgggggaaacucugucccaagugccugaacuguacagaucuugacguggcucugggacgcccuaagugcaccggcaauauccccucugccgaagucagcauucuccacgaggugagaccuguuacauccggguguuuucccaucaugcaugaucggaccaaaauccgccaacugccuaaccugcucagaggauacgaacacauucggcugucuacgcauaaugugaucaacgccgagaaggcuccgggcggccccuauaaaauugggacaagcggauccugcccuaaugucaccaacggcaauggguucuuugccacaauggcuugggccgugcccaagaacgacaauaacaaaaccgcgaccaauagccuuacaaucgaagugccuuacauuuguacggagggagaggaucagaucaccauuuggggcuuccacucugacaacgaaauccagauggccaagcuguauggggauuccaagccccagaaauuuacaagcucugcuaacggagucaccacacacuacguuucccaaaucggcggcuucccgaaucagaccgaggacgggggacucccucagagcggccgcauugugguggauuauaugguccagaagucugggaaaacgggaacaaucaccuaccaaagaggcauucugcuuccccagaagguguggugcgccuccgggcggagcaaaguuaucaagggaucccugccucucauuggcgaagcugacugucugcaugagaaauauggcgggcugaacaagucuaagcccuacuacaccggagagcacgccaaagcgaucggcaauugccccaucugggugaagacaccucucaaacuggccaacgggaccaaguaucgcccgcccgcuaaacuucugaaggaaagaggauuuuucggcgccauugcuggguuucucgagggcggaugggaaggcaugaucgccggguggcauggauacacaagccacggcgcccacggggucgcuguggcggccgaucugaaguccacgcaggaggcuauuaauaaaaucaccaagaaccuuaauagccugucugaacucgagguuaaaaaccugcagcggcuguccggagccauggacgagcuccauaaugaaauucuggagcuugaugaaaagguggacgaccugcgcgccgauacaaucagcucucaaaucgagcucgcuguccugcuuagcaacgaaggcauuaucaauuccgaggacgagcaucugcucgcccuggaaagaaaacugaagaagaugcucgggccuucugcgguggagauuggcaacggauguuucgaaaccaaacacaagugcaaucagacaugccuggaucggaucgcugccggcaccuuugacgccggggaguucagccuucccacguuugauucccugaacauuaccgcugccagccucaaugacgauggacuggacaaccacacaauccugcuuuauuacucuaccgcugccuccagccucgcggucacacugaugauugccaucuucgugguuuauauggugucucgcgauaacgucuccuguagcaucugccuguga

SEQ ID NO: 209508 - RNA, 1758 nt, Artificial Sequence
  derived and/or modified sequence opt5 from hemagglutinin__InfluenzaB__ABN50470
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaaaaagcuccgggcggccccuauaagaucgggacgagcggauccugcccuaacgucacaaauggcaacggguucuuugccaccauggcuugggccgugcccaaaaaugagaacaauaagacagcgaccaacagccugaccauugaagugccuuacaucuguacagagggagaggaccagauuacggucuggggcuuccauucugauaacgaaauccagauggccaaacuuuauggggacuccaagccccagaaguuuaccagcucugcuaauggaguuacaacccacuacgugucccaaaucggcggcuucccgaaccagacagaggaugggggacugccucagagcggcagaauuguggucgacuauauggugcagaaaucugggaagaccggaacgaucacauaccaacggggcauucuccugccccagaaaguuuggugcgccuccgggcgcagcaaggugaucaaaggaucccuuccucugauuggcgaagcugauugucuccacgagaaguauggcgggcugaauaagucuaaacccuacuacaccggagagcaugccaaggcgaucggcaacugccccaucugggucaaaaccccucugaagcucgccaaugggacaaaauauagaccgcccgcuaagcugcuuaaggaacggggauuuuucggcgccauugcuggguuucuggagggcggaugggaaggcaugaucgccggguggcacggauacaccagccauggcgcccacgggguggcuguugcggccgaccucaaauccacacaggaggcuauuaacaagaucacgaaaaaucugaacagccuuucugaacuggaggugaagaaucuccagcgccuguccggagccauggaugagcugcacaacgaaauucucgagcuggacgaaaaagucgaugaccuuagagccgacaccaucagcucucaaaucgagcuggcugugcuccugagcaaugaaggcauuaucaacuccgaggaugagcaucuucuggcccucgaacggaagcugaagaaaaugcuggggccuucugcggucgagauuggcaauggauguuucgaaacaaagcacaaaugcaaccagaccugccucgaccgcaucgcugccggcacauuuaaugccggggaguucagccugcccaccuuugauucccuuaacauuacggcugccagccugaacgacgauggacucgacaaucauaccauccugcuguauuacucuacagcugccuccagccuugcggugacccucaugauugccaucuucguuguguauauggucucuagagauaacguguccuguagcaucugccuguga

SEQ ID NO: 209509 - RNA, 1755 nt, Artificial Sequence
  derived and/or modified sequence opt5 from hemagglutinin__InfluenzaB__ABN50481
augaaggccaucauugugcugcuccuggucguuaccagcaacgcugacagaaucugcacaggcauuacguccucuaauagcccccacguggugaaaaccgccacacagggggaggucaacgugaccggagcgaucccucuuacaaccacaccgaccaagucccauuucgcuaaucugaaaggcacgaagacccgggggaaacucugucccacaugcuuuaacuguaccgaucuggacguugcccuuggacgcccuaugugcgugggcauuacacccucugccaaggcuagcauccugcacgaagucagaccugugaccuccggguguuuccccaucaugcaugaucggacgaagauucgccaacucccuaaucugcugagaggauacgagaaaauccggcucucuacacagaacguuauugacgccgaaaaggcuccgggcggccccuaucgccuggggaccagcggauccugcccuaaugccacaagcaaaucuggcuuuuucgcgaccauggccugggcugugcccagagauaacaauaagaccgccacaaacccucuuacggucgaggugccccacaucuguaccaaagaagaggaccagauuacaguguggggguuucauuccgauaauaagacccagaugaagaaccuguacggagacagcaauccgcaaaaauucacaucuuccgcuaacggcaucaccacgcacuaugucagccagauugggggauuuccugaucagacagaggacggcggccucccccagucugggcggaucguuguggauuacauggugcaaaagccuggaaaaaccggcaccaucgucuaucagcgcgggauucugcuuccccagaagguguggugcgccuccggaagaagcaaaguuaucaagggcucccugccccucauuggggaagcggacugucugcacgagaaauacggaggccugaauaagucuaagccuuauuacacaggcgaacaugccaaagcuaucgggaacugcccgauuugggugaagacaccccucaaacuggccaacggaaccaaguaccggccucccgcuaaacuucugaaggagcgcggcuucuuuggggccaucgccggauuccucgagggcgggugggaaggcaugaucgcuggauggcacggcuauacgagccauggggcgcacggagucgccguggcugccgaucugaaguccacccaggaggccauuaauaaaaucacaaagaaccuuaauagccugucugaacucgagguuaaaaaccugcaaagacuguccggcgcuauggacgaacuccacaaugagauucuggagcuugacgaaaagguggaugaccugcgggccgauaccaucagcucucagauugagcucgcgguccugcuuagcaacgaagggaucaucaauuccgaggacgaacaucugcucgcucuggagcgcaaacugaagaagaugcucggaccuucugccguggauauuggcaacggguguuuugagacaaaacacaagugcaaucagaccugccuggacagaaucgccgcuggcacguucaacgccggagaauuuagccuucccaccuucgauucccugaauauuacagcugccagccucaacgacgauggccuggacaaucauaccauccugcuuuacuauucuacagcggccuccagccucgcugucacccugaugauugccaucuucauuguguacaugaucucucgggauaacguuuccuguagcaucugccuguga

SEQ ID NO: 209510 - RNA, 1755 nt, Artificial Sequence
  derived and/or modified sequence opt5 from hemagglutinin__InfluenzaB__ABN50503
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcgugacacccucugccaaggccagcauucugcacgaaguuagaccugugaccuccggguguuuucccaucaugcaugaucggacgaagauccgccaacucccuaaucugcugagaggauacgagaaaauucggcucucuacacagaacgucaucaaugcugaaaaggccccgggcggccccuaucgccuggggaccagcggauccugcccuaacgcuacaagcagaucuggcuucuuugccaccauggcgugggccgugcccaaagacaauaacaagaccgcuacaaauccucuuacgguggaggucccccacauuuguaccaaagaagaggaucagaucacaguuuggggguuccauuccgacgauaagacccagaugaagaaccuguacggagacagcaauccgcaaaaauuuacaucuuccgccaacggcgugaccacgcacuaugugagccagauugggggauucccugaucagacagaggacggcggccucccccagucugggcggaucgucguggauuacaugguucaaaagccuggaaaaaccggcaccauuguguaucagcgcgggauccugcuuccccagaaggucuggugcgcuuccggaagaagcaaagugaucaagggcucccugccccucauuggggaagccgacugucugcacgagaaauacggaggccugaauaagucuaagccuuauuacacaggcgaacaugcgaaagccaucgggaacugcccgauuuggguuaagacaccccucaaacuggcuaacggaaccaaguaccggccucccgccaaacuucugaaggagcgcggcuuuuucggggcuaucgccggauuucucgagggcgggugggaaggcaugauugccggauggcacggcuauacgagccauggggcucacggaguggcggucgccgcugaucugaaguccacccaggaggccaucaauaaaaucacaaagaaccuuaauagccugucugaacucgaggugaaaaaccugcaaagacuguccggcgccauggacgaacuccacaaugagauucuggagcuugacgaaaaggucgaugaccugcgggcugauaccaucagcucucagauugagcucgccgugcugcuuagcaacgaagggaucauuaauuccgaggacgaacaucugcucgcgcuggagcgcaaacugaagaagaugcucggaccuucugcuguugauaucggcaacggguguuucgagacaaaacacaagugcaaucagaccugccuggacagaaucgccgccggcacguuuaacgcuggagaguucagccuucccaccuuugauucccugaauauuacagccgcuagccucaacgacgauggccuggacaaucauaccauccugcuuuacuauucuacagccgcguccagccucgccgugacccugaugauugcuaucuucauugucuacaugaucucucgggauaacguguccuguagcauuugccuguga

SEQ ID NO: 209511 - RNA, 1755 nt, Artificial Sequence
  derived and/or modified sequence opt5 from hemagglutinin__InfluenzaB__ABN50514
augaaggccaucauugugcugcucauggucgcuaccagcaacgccgacagaaucugcacaggcauuacguccucuaauagcccccacguugugaaaaccgcgacacagggggaggugaacgucaccggagugaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaucuggcuucuuugcgaccauggccugggcugugcccaaggacaauaacaaaaaugccaccaacccucuuacagucgaggugcccuauguguguacggaaggggaggaucagauuaccgucuggggauuccauuccgacaauaagccgcagaugaaaaaccuguacggcgauagcaauccucaaaaguuuacaucuuccgcuaacgggguuaccacacacuaugugagccagaucggaggcuuccccgaccagaccgaggauggcgggcucccucagucuggacggauuguggucgacuacauggugcaaaagcccggcaaaacggggacaaucguuuaucagcgcggagugcugcuuccccagaaggucuggugcgccuccggcagaagcaaagugauuaaggggucccugccucucaucggagaagcggauugucugcaugagaaauacggcggccugaacaagucuaaaccguacuauaccggggaacacgccaaggcuaucggaaauugccccauuuggguuaagaccccucucaaacuggccaacggcacaaaguaccggcccccugcuaaacuucugaaggagcgcggguuuuucggagccaucgccggcuuucucgaagggggcugggaaggaaugauugcuggcuggcacggguauaccagccauggagcgcacggcguggccgucgcugccgaccugaaauccacacaggaggccaucaauaagauuacgaagaaccuuaauagccugucugaacucgaggugaaaaaccugcaaagacuguccggggcuauggacgaacuccaugaugagauccuggagcuugacgaaaaggucgaugaccugcgggccgauaccaucagcucucagauugagcucgcggugcugcuuagcaaugaaggaaucauuaacuccgaggacgaacaucugcucgcucuggagcgcaaacugaagaaaaugcucggccccucugccguugauaucgggaauggcuguuucgagacaaagcacaagugcaaccagaccugccuggacagaauugccgcuggaacauuuaaugccggcgaguucagccuuccgaccuuugauucccugaacaucacggcugccagccucaaugacgaugggcuggacaaccacaccauccugcuuuacuauucuacagcggccuccagccucgcugugacccugaugcuggccauuuucaucgucuacauggugucucgggacaauguuuccuguagcauuugccucuga

SEQ ID NO: 209512 - RNA, 1755 nt, Artificial Sequence
  derived and/or modified sequence opt5 from hemagglutinin__InfluenzaB__ABN50525
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuuuccaccauggccugggcgguccccaaggacaauaacaaaaaugccaccaacccucuuacaguggaggugcccuaugucuguacggaaggggaggaucagauuaccguuuggggauuccauagcgacaauaagacacagaugaaaaaccuguacggcgauucuaauccgcaaaaguuuaccuccagcgcuaacggggugacaacccacuaugugucucagaucggaggcuucccugaccagacggaggauggcgggcucccccaguccggacggauugucguggacuacaugguucaaaagccuggcaaaacagggaccaucguguaucagcgcggaguccugcuuccccagaagguguggugcgccagcggcagauccaaaguuauuaaggggucucugccccucaucggagaagcugauugucugcaugagaaauacggcggccugaacaagagcaaaccuuacuauaccggggaacacgccaaggcgaucggaaauugcccgauuugggugaagacaccccucaaacuggccaacggcaccaaguaccggccucccgcuaaacuucugaaggagcgcggguuuuucggagccaucgcuggcuuucucgaagggggcugggaaggaaugauugccggcuggcacggguauacaucccauggagcccacggcgucgcuguggcggccgaccugaaaagcacgcaggaggcuaucaauaagauuaccaagaaccuuaauucucuguccgaacucgaggucaaaaaccugcaaagacugagcggggccauggacgaacuccauaaugagauccuggagcuugaugaaaagguggacgaucugcgggccgacacaaucucuagccagauugagcucgcuguucugcuuuccaacgaaggaaucauuaauucugaggaugaacaucugcucgcccuggagcgcaaacugaagaaaaugcucggcccuagcgcgguggacaucgggaacggcuguuucgagaccaagcacaagugcaaucagacaugccuggauagaauugcugccggaaccuuuaacgccggcgaguucucccuucccacguuugacagccugaauaucaccgcugccucucucaacgaugacgggcuggauaaucacacaauccugcuuuacuauuccaccgcugccagcucucucgcggucacacugaugcuggccauuuucaucguguacaugguuucccgggacaacgugagcuguuccauuugccucuga

SEQ ID NO: 209513 - RNA, 1758 nt, Artificial Sequence
  derived and/or modified sequence opt5 from hemagglutinin__InfluenzaB__ABN50536
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaagaggcuccgggcggccccuauaaaaucgggacgagcggauccugcccuaacgucacaaauggcaacggguucuuugccaccauggcuugggccgugcccaagaaugaaaacaauaaaacagcgaccaacagccugaccauugaggugccuuacaucuguacagagggagaagaccagauuacggucuggggcuuccauucugauaacgagauccagauggccaaacuuuauggggacuccaagccccagaaguuuaccagcucugcuaauggaguuacaacccacuacgugucccaaaucggcggcuucccgaaccagacagaagaugggggacugccucagagcggcagaauuguggucgacuauauggugcagaagucugggaaaaccggaacgaucacauaccaacggggcauucuccugccccagaagguuuggugcgccuccgggcgcagcaaagugaucaagggaucccuuccucugauuggcgaggcugauugucuccacgagaaauauggcgggcugaauaagucuaagcccuacuacaccggagaacaugccaaagcgaucggcaacugccccaucugggucaagaccccucugaaacucgccaaugggacaaaguauagaccgcccgcuaaacugcuuaaggagcggggauuuuucggcgccauugcuggguuucuggaaggcggaugggagggcaugaucgccggguggcacggauacaccagccauggcgcccacgggguggcuguugcggccgaccucaaguccacacaggaagcuauuaacaaaaucacgaagaaucugaacagccuuucugagcuggaggugaaaaaucuccagcgccuguccggagccauggaugaacugcacaacgagauucucgaacuggacgagaaggucgaugaccuuagagccgacaccaucagcucucaaaucgaacuggcugugcuccugagcaaugagggcauuaucaacuccgaggaugaacaucuucuggcccucgagcggaaacugaagaagaugcuggggccuucugcggucgaaauuggcaauggauguuucgagacaaaacacaagugcaaccagaccugccucgaccgcaucgcugccggcacauuuaaugccggggaguucagccugcccaccuuugauucccuuaacauuacggcugccagccugaacgacgauggacucgacaaucauaccauccugcuguauuacucuacagcugccuccagccuugcggugacccucaugauugccaucuucguuguguauauggucucuagagauaacguguccuguagcaucugccuguga

SEQ ID NO: 209514 - RNA, 1758 nt, Artificial Sequence
  derived and/or modified sequence opt5 from hemagglutinin__InfluenzaB__ABN50547
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagcuuaccgucuggggcuuccacucugacaacgagaaccagauggccaagcuguauggggauuccaaaccccagaaguuuacaagcucugcuaauggaguuaccacacacuacgugucccaaauuggcggcuucccgaaccagaccgaagacgggggacucccucagagcggccgcaucguggucgauuauauggugcagaaaucugggaagacgggaacaaucaccuaccaaagaggcauucugcuuccccagaaaguuuggugcgccuccgggcggagcaaggugaucaaaggaucccugccucucauuggcgaggcugacugucugcaugaaaaguauggcgggcugaauaagucuaaacccuacuacaccggagagcacgccaaggcgaucggcaacugccccauuugggucaaaacaccucucaagcuggccaaugggaccaaauaucgcccgcccgcuaagcugcugaaggagagaggauuuuucggcgccaucgcuggguuucucgaaggcggaugggagggcaugaucgccggguggcauggauacacaagccacggcgcccacgggguggcuguugcggccgaucugaaauccacgcaggaagcuauuaacaagaucaccaaaaaucuuaacagccugucugagcucgaagugaagaaucugcagcggcuguccggagccauggacgagcuccauaacgagauucuggaacuugaugagaaagucgacgaccugcgcgccgauacaaucagcucucaaauugaacucgcugugcugcuuagcaaugagggcaucaucaacuccgaagacgagcaccuucucgcccuggagagaaagcugaagaaaaugcucgggccuucugcggucgaaauuggcaauggauguuucgagaccaagcauaaaugcaaccagacaugccuggaucggaucgcugccggcaccuuugacgccggggaguucagccuucccacguuugauucccugaauauuaccgcugccagccucaacgacgauggacuggacaaccacacaauccugcuuuauuacucuaccgcugccuccagccucgcggugacacugaugauugccaucuucguuguguauauggucucucgcgauaauguguccuguagcauuugccuguga

SEQ ID NO: 209515 - RNA, 1758 nt, Artificial Sequence
  derived and/or modified sequence opt5 from hemagglutinin__InfluenzaB__ABN50558
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaaggagacacagauggccaaacuuuauggggauuccaagccccagaaauuuaccagcucugcuaacggaguuacaacccacuacgugucccaaaucggcggcuucccgaaccagacggaagacgggggacugccucagagcggccgcaucguggucgauuauaugaugcagaagucugggaaaacaggaaccauuaccuaccaaagaggcauccuccugccccagaagguguggugcgccuccgggcggagcaaaguuauuaagggaucccuuccucugaucggcgaggcugacugucuccaugaaaaguauggcgggcugaauaaaucuaagcccuacuacacaggagagcacgccaaagcgauuggcaacugccccaucugggugaagaccccucugaaacucgccaaugggacaaaguaucgcccgcccgcuaagcugcuuaaagagagaggauuuuucggcgccaucgcuggguuucuggaaggcggaugggagggcaugauugccggguggcauggauacacgagccacggcgcccacggggucgcuguggcggccgaucucaaguccacccaggaagcuaucaacaaaauuacaaagaaucugaacagccuuucugagcuggaaguuaaaaaucuccagcggcuguccggagccauggacgagcugcauaacgagauccucgaacuggaugagaagguggacgaccuucgcgccgauaccauuagcucucaaaucgaacuggcuguccuccugagcaaugagggcaucauuaacuccgaagacgagcaccuucuggcccucgagagaaagcugaaaaagaugcuggggccuucugcgguggaaaucggcaauggauguuucgagacaaaacauaagugcaaccagaccugccucgaucggauugcugccggcacguuugacgccggggaguucagccugcccaccuuugauucccuuaauaucacagcugccagccugaacgacgauggacucgacaaucacaccauucugcuguauuacucuacagcugccuccagccuugcggucacccucaugaucgccauuuucgugguuuauauggugucucgcgauaacgucuccuguagcaucugccuguga

SEQ ID NO: 209516 - RNA, 1755 nt, Artificial Sequence; identical to SEQ ID NO: 209431
  derived and/or modified sequence opt5 from hemagglutinin__InfluenzaB__ABN50569

SEQ ID NO: 209517 - RNA, 1758 nt, Artificial Sequence; identical to SEQ ID NO: 209443
  derived and/or modified sequence opt5 from hemagglutinin__InfluenzaB__ABN50580

SEQ ID NO: 209518 - RNA, 1758 nt, Artificial Sequence
  derived and/or modified sequence opt5 from hemagglutinin__InfluenzaB__ABN50591
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaaaaagcuccgggcggccccuauaagaucgggacgagcggauccugcccuaacgucacaaauggcaacggguucuuugccaccauggcuugggccgugcccaaaaaugagaacaauaagacagcgaccaacagccugaccauugaagugccuuacaucuguacagagggagaggaccagauuacggucuggggcuuccauucugauaacgaagcccagauggcuaaacuuuauggggacuccaagccccagaaguuuaccagcucugccaauggaguuacaacccacuacgugucccaaaucggcggcuucccgaaccagacagaggaugggggacugccucagagcggcagaaucguggucgacuauauggugcagaaaucugggaagaccggaacgauuacauaccaacggggcauccuccugccccagaaaguuuggugcgcuuccgggcgcagcaaggugauuaaaggaucccuuccucugaucggcgaagccgauugucuccacgagaaguauggcgggcugaauaagucuaaacccuacuacaccggagagcaugcgaaggccauuggcaacugccccaucugggucaaaaccccucugaagcucgcuaaugggacaaaauauagaccgcccgccaagcugcuuaaggaacggggauuuuucggcgcuaucgccggguuucuggagggcggaugggaaggcaugauugccggguggcacggauacaccagccauggcgcucacgggguggcgguugccgcugaccucaaauccacacaggaggccaucaacaagauuacgaaaaaucugaacagccuuucugaacuggaggugaagaaucuccagcgccuguccggagccauggaugagcugcacaacgaaauccucgagcuggacgaaaaagucgaugaccuuagagcugacaccauuagcucucaaaucgagcuggccgugcuccugagcaaugaaggcaucauuaacuccgaggaugagcaucuucuggcgcucgaacggaagcugaagaaaaugcuggggccuucugcugucgagaucggcaauggauguuucgaaacaaagcacaaaugcaaccagaccugccucgaccgcauugccgccggcacauuuaaugcuggggaguucagccugcccaccuuugauucccuuaacaucacggccgcuagccugaacgacgauggacucgacaaucauaccauucugcuguauuacucuacagccgcguccagccuugccgugacccucaugaucgcuauuuucguuguguauauggucucuagagauaacguguccuguagcaucugccuguga

SEQ ID NO: 209519 - RNA, 1758 nt, Artificial Sequence
  derived and/or modified sequence opt5 from hemagglutinin__InfluenzaB__ABN50602
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaugggcaccauucccucugccaaagccagcauccugcacgaagucaagccugugacauccggguguuuucccaucaugcaugauagaaccaaaauucggcaacucccuaaucugcugcgcggauacgagaacaucagacucucuacgcacaauguuauuaacgcugaaacagccccgggcggccccuauaagaucgggaccagcggauccugcccuaauauuacaaacggcaauggguucuuugcuaccauggccugggcggugcccaaaaacgacaauaacaagaccgccacaaauccucugacggucgaggugcccuacaucuguaccgaaggagaggaucagauuacaguguggggcuuccauagcgacaacgagacccagauggucaagcuguauggggauucuaaaccgcagaaguuuacauccagcgcuaacggaguuaccgcccacuacgugucucaaaucggcggcuucccuaaucaggcugaagacgggggacugccccaguccggccggaucguggucgauuauauggugcagaaaagcgggaagacgggaacaauuaccuaccaacgcggcauccuccugccucagaaaguuuggugcgccucugggagauccaaggugauuaaaggaagccuuccccugaucggcgaggcggacugucuccacgaaaaguauggcgggcugaacaaguccaaacccuacuacaccggagagcaugccaaggcuauuggcaauugcccuaucugggucaaaacaccgcugaagcucgccaacgggaccaaauaucggcccccugcuaagcugcuuaaggagcgcggauuuuucggcgccaucgccggguuucuggaaggcggaugggagggcaugauugcuggguggcacggauacacaucucauggcgcgcacgggguggccguugcugccgaucucaaaagcacgcaggaagccaucaauaagauuaccaaaaaccuuaauucccuuagcgagcuggaagugaagaaccuccagagacugucuggagcuauggacgagcugcacaaugagauccucgaacuggaugagaaagucgacgaccuucgggccgauacaauuuccagccaaaucgaacuggcggugcuccugucuaacgagggcaucauuaauagcgaagacgagcaucuucuggcucucgagcgcaagcugaagaaaaugcuggggcccuccgccgucgauaucggcaacggauguuucgaaaccaagcacaaaugcaaucagacaugccucgacagaauugccgcuggcaccuuuaacgccggggaguucucucugccuacguuugauagccuuaauaucaccgcugccucccugaacgacgauggacucgacaaccauacaauucugcuguauuacagcaccgcggccucuucccuugcugugacacucaugaucgccauuuucaucguuuauauggugagccgggauaaugucucuuguuccaucugccuguga

SEQ ID NO: 209520 - RNA, 1752 nt, Artificial Sequence
  derived and/or modified sequence opt5 from hemagglutinin__InfluenzaB__ABN50624
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagaauauucggcucucuacgcacaacguuaucaaugcugaacgcgccccgggcggccccuauagacuggggacaagcggauccugcccuaacgugaccagcaaaucuggcuucuuugcuacaauggccugggcggucccccgggacaauaagaccgccaccaacccucuuacaguggaggugcccuacauuuguacgaaaggggaagaucagaucaccgucuggggauuccauuccgacaauaagaaccagaugaaaaaucuguauggcgauagcaacccgcagaaguuuacaucuuccguuaacggggugaccacacacuacgugagccaaauuggaggcuucccuaaucagaccgaggacggcgggcucccccagucuggacgcaucgucguggauuauaugguucagaagccuggcaaaacggggacaaucguguaccaaagaggaguccugcuuccccagaagguguggugcgcuuccggccggagcaaaguuauuaaggggucccugccccucaucggagaggccgacugucugcacgaaaaauauggcggccugaacaagucuaaaccuuacuacaccggggagcaugcuaaggccauuggaaauugcccgaucugggugaagacaccccucaaacuggcgaacggcaccaaguaucgcccucccgccaaacuucugaaggaaagaggguuuuucggagcuauugccggcuuucucgaagggggcugggagggaaugaucgcuggcuggcacggguacaccagccauggagcccacggcgucgccguggcugcggaucugaaauccacacaggaggccaucaauaagauuacgaagaaccuuaauagccugucugagcucgaagucaaaaaccugcagcggcuguccggggcuauggacgagcuccacaaugaaauccuggagcuugaugagaagguggacgaccugcgcgccgauaccauuagcucucaaaucgaacucgccguucugcuuagcaacgagggaauuaucaauuccgaagacgagcaucugcucgcucuggaaagaaaacugaagaaaaugcucggcccuucugccguggauaucgggaacggcuguuucgagacaaagcacaagugcaaucagaccugccuggaccggauugcggcuggaacauuuaacgccggcgaguucagccuucccaccuuugauucccugaauaucacggccgcuagccucaacgacgaugggcuggacaaccauaccauucugcuuuauuacucuacagccgcuuccagccucgccgucacccugaugaucgcgauuuucaucguguauaugguuucuagagauaauguguccuguagcauuugccuguga

SEQ ID NO: 209521 - RNA, 1752 nt, Artificial Sequence
  derived and/or modified sequence opt5 from hemagglutinin__InfluenzaB__ABN50635
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacagcaaaacacagaugaagaaccuguauggcgauucuaauccgcagaaauuuaccuccagcgcuaacgggguuacaacccacuacgugucucaaauuggaggcuucccuaaucagacggaggacggcgggcucccccaguccggaagaaucguggucgauuauauggugcagaagccuggcaagacagggaccaucguuuaccaacggggagugcugcuuccccagaaagucuggugcgccagcggccgcuccaaggugauuaaagggucucugccccucaucggagaggcugacugucugcaugaaaaguauggcggccugaacaaaagcaagccuuacuacaccggggagcacgccaaagcgauuggaaacugcccgaucuggguuaagacaccccucaagcuggccaauggcaccaaauauagaccucccgcuaagcugcugaaagaacggggguuuuucggagccauugcuggcuuucucgaagggggcugggagggaaugaucgccggcuggcauggguacacaucccacggagcccacggcguggcugucgcggccgaucuuaagagcacgcaggaggcuaucaacaaaauuaccaagaaucuuaacucucuguccgagcucgaagugaagaaucugcagcgccugagcggggccauggacgagcuccauaacgaaauccuggagcuugaugagaaagucgacgaccugagagccgauacaauuucuagccaaaucgaacucgcugugcugcuuuccaaugagggaauuaucaacucugaagacgagcaucugcucgcccuggaacggaagcugaaaaagaugcucggcccuagcgcgguugauaucgggaauggcuguuucgagaccaaacacaagugcaaccagacaugccuggacagaauugcugccggaaccuuuaaugccggcgaguucucccuucccacguuugauagccugaacaucaccgcugccucucucaaugacgaugggcuggacaaccacacaauucugcuuuauuacuccaccgcugccagcucucucgcggugacacugaugaucgccauuuucaucgucuauauggugucccgcgauaauguuagcuguuccauuugccuguga

SEQ ID NO: 209522 - RNA, 1752 nt, Artificial Sequence
  derived and/or modified sequence opt5 from hemagglutinin__InfluenzaB__ABN50646
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacaacaaaaaucagaugaagaaccuguauggcgauagcaauccgcagaaauuuacaucuuccgcuaacgggguuaccacacacuacgugagccaaauuggaggcuucccuaaccagaccgaggacggcgggcucccccagucuggaagaaucguggucgauuauauggugcagaagccuggcaagacggggacaaucguuuaccaacggggagugcugcuuccccagaaagucuggugcgccuccggccgcagcaaggugauuaaagggucccugccccucaucggagaggcugacugucugcaugaaaaguauggcggccugaauaaaucuaagccuuacuacaccggggagcacgccaaagcgauuggaaacugcccgaucuggguuaagacaccccucaagcuggccaauggcaccaaauauagaccucccgcuaagcugcugaaagaacggggguuuuucggagccauugcuggcuuucucgaagggggcugggagggaaugaucgccggcuggcauggguacaccagccacggagcccacggcguggcugucgcggccgaucugaaguccacacaggaggcuaucaacaaaauuacgaagaaucuuaacagccugucugagcucgaagugaagaaucugcagcgccuguccggggccauggacgagcuccauaacgaaauccuggagcuugaugagaaagucgacgaccugagagccgauaccauuagcucucaaaucgaacucgcugugcugcuuagcaaugagggaauuaucaacuccgaagacgagcaccuucucgcccuggaacggaagcugaaaaagaugcucggcccuucugcgguugauaucgggaauggcuguuucgagacaaaacauaagugcaaccagaccugccuggacagaauugcugccggaacauuuaaugccggcgaguucagccuucccaccuuugauucccugaacaucacggcugccagccucaaugacgaugggcuggacaaccacaccauucugcuuuauuacucuacagcugccuccagccucgcggugacccugaugaucgccauuuucaucgucuauauggugucucgcgauaacguuuccuguagcauuugccuguga

SEQ ID NO: 209523 - RNA, 1752 nt, Artificial Sequence
  derived and/or modified sequence opt5 from hemagglutinin__InfluenzaB__ABN50657
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcauuacccccucugccaaggccagcauccugcacgaagugagaccuguuacauccggguguuuucccaucaugcaugaucggaccaagauucgccaacucccuaaccugcugagaggauacgagaauauccggcucucuacgcagaacgugauuaaugcugaaaaagccccgggcggccccuaucgccuggggacaagcggauccugcccuaacgucaccagcagaacaggcuucuuugcuaccauggccugggcggugccccgggacaauaagaccgccacaaacccucuuacgguggagguccccuacaucuguaccaaaggggaagaucagauuacaguuuggggauuccacucugacaauaagacccagaugaaaaaccuguauggcgauuccaauccgcaaaaguuuacaagcucugcuaacggggugaccacgcauuacgugucccagaucggaggcuucccugaccagacagaggauggcgggcucccccagagcggacgcauugucguggacuauaugguucaaaagccuggcaaaaccgggaccaucguguaccagagaggaauccugcuuccccagaaggucuggugcgccucuggccgguccaaagugauuaaggggagccugccccucaucggagaggcugauugucugcacgaaaaauauggcggccugaacaaguccaaaccuuacuacacaggggagcacgccaaggcgauuggaaauugcccgaucuggguuaagacaccccucaaacuggccaacggcaccaaguaucgcccucccgcuaaacuucugaaggaaagaggguuuuucggagccauugcuggcuuucucgaagggggcugggagggaaugaucgccggcuggcauggguacacgucucacggagcccauggcguggcugucgcggccgaccugaaaagcacccaggaggcuaucaauaagauuacaaagaaccuuaauucccugagcgagcucgaagugaaaaaccugcaacggcugucuggggccauggaugagcuccacaaugaaauccuggagcuugacgagaaggucgacgaucugcgcgccgacaccauuuccagccagaucgaacucgcugugcugcuuucuaacgagggaauuaucaauagcgaagaugagcaucugcucgcccuggaaagaaaacugaagaaaaugcucggcccuuccgcgguugacaucgggaacggcuguuucgagacaaagcacaagugcaaucagaccugccuggaucggauugcugccggaacguuuaacgccggcgaguucucucuucccaccuuugacagccugaauaucacagcugccucccucaacgaugacgggcuggauaaucacaccauucugcuuuauuacagcacagcugccucuucccucgcggugacccugaugaucgccauuuucaucgucuauauggugagcagagacaacguuucuuguuccauuugccuguga

SEQ ID NO: 209524 - RNA, 1755 nt, Artificial Sequence
  derived and/or modified sequence opt5 from hemagglutinin__InfluenzaB__ABN50679
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuaucgccuggggaccagcggauccugcccuaacgcuacaagcagaucuggcuucuuugccaccauggcgugggccgucccccgggacaauaacaagaccgcuacaaauccucuuacgguggaggugcccuacauuuguaccaaaggggaagaucagaucacagucuggggauuccacuccgacgauaagacccagaugaaaaaccuguauggcgacagcaauccgcaaaaguuuacaucuuccgccaacgggguuaccacgcauuacgugagccagauuggaggcuucccugaucagacagaggacggcgggcucccccagucuggacgcaucguggucgauuauauggugcaaaagccuggcaaaaccgggaccauuguuuaccagagaggagugcugcuuccccagaaggucuggugcgcuuccggccggagcaaagugaucaaggggucccugccccucaucggagaggccgacugucugcacgaaaaauauggcggccugaacaagucuaaaccuuacuacacaggggagcacgcgaaggccauuggaaauugcccgaucuggguuaagacaccccucaaacuggcuaacggcaccaaguaucgcccucccgccaaacuucugaaggaaagaggguuuuucggagcuauugccggcuuucucgaagggggcugggagggaaugaucgccggcuggcauggguacacgagccacggagcucauggcguggcggucgccgcugaucugaaauccacccaggaggccauuaauaagaucacaaagaaccuuaauagccugucugagcucgaagugaaaaaccugcaacggcuguccggggccauggacgagcuccacaaugaaauccuggagcuugacgagaaggucgaugaccugcgcgcugauaccauuagcucucagaucgaacucgccgugcugcuuagcaacgagggaauuaucaauuccgaagacgagcaucugcucgcgcuggaaagaaaacugaagaaaaugcucggcccuucugcuguugauauugggaacggcuguuucgagacaaagcacaagugcaaucagaccugccuggaccggaucgccgccggaacguuuaacgcuggcgaguucagccuucccaccuuugauucccugaauaucacagccgcuagccucaacgacgaugggcuggacaaucacaccauucugcuuuauuacucuacagccgcguccagccucgccgugacccugaugaucgcuauuuucaucgucuauauggugucuagagauaacguuuccuguagcauuugccuguga

SEQ ID NO: 209525 - RNA, 1755 nt, Artificial Sequence
  derived and/or modified sequence opt5 from hemagglutinin__InfluenzaB__ABN50690
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuaucgccuggggaccagcggauccugcccuaacgcuacaagcagaucuggcuucuuugccaccauggcgugggccgucccccgggacaauaacaagaccgcuacaaauccucuuacgguggaggugcccuacgucuguaccgaaggggaggaucagauuacaguuuggggauuccacuccgacaacaaaacccagaugaagaaucuguauggcgauagcaacccgcaaaaauuuacaucuuccgccaacggggugaccacgcauuacgugagccagaucggaggcuucccugaccagacagaggauggcgggcucccccagucuggacgcauugucguggacuauaugguucaaaagccuggcaagaccgggaccaucguguaccagagaggaguccugcuuccccagaaaguguggugcgcuuccggccggagcaagguuauuaaagggucccugccccucaucggagaagccgauugucugcacgagaaguauggcggccugaauaaaucuaagccuuacuacacaggggaacacgcgaaagccaucggaaacugcccgauuugggugaagacaccccucaagcuggcuaauggcaccaaauaucgcccucccgccaagcugcugaaagagagaggguuuuucggagcuaucgccggcuuucucgaagggggcugggaaggaaugauugccggcuggcauggguacacgagccacggagcucauggcgucgcgguggccgcugaccugaaguccacccaggaggccaucaacaaaauuacaaagaaucuuaacagccugucugaacucgaggucaagaaucugcaacggcuguccggggccauggaugaacuccacaacgagauccuggagcuugacgaaaaaguggacgaucugcgcgcugacaccaucagcucucagauugagcucgccguucugcuuagcaaugaaggaaucauuaacuccgaggaugaacaccuucucgcgcuggagagaaagcugaaaaagaugcucggcccuucugcuguggacaucgggaauggcuguuucgagacaaaacauaagugcaaccagaccugccuggaucggauugccgccggaacguuuaaugcuggcgaguucagccuucccaccuuugacucccugaacaucacagccgcuagccucaaugaugacgggcuggauaaccacaccauccugcuuuauuacucuacagccgcguccagccucgccgucacccugaugauugcuaucuucauuguguauaugguuucuagagacaacguguccuguagcaucugccuguga

SEQ ID NO: 209526 - RNA, 1752 nt, Artificial Sequence
  derived and/or modified sequence opt5 from hemagglutinin__InfluenzaB__ABN50701
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcauuacccccucugccaaggccagcauccugcacgaagugagaccuguuacauccggguguuuucccaucaugcaugaucggaccaagauucgccaacucccuaaccugcugagaggauacgagaauauccggcucucuacgcagaacgugauuaaugcugaaaaagccccgggcggccccuaucgccuggggacaagcggauccugcccuaacgucaccagcagaacaggcuucuuugcuaccauggccugggcggugccccgggacaauaagaccgccacaaacccucuuacgguggagguccccuacaucuguaccaaaggggaagaucagauuacaguuuggggauuccacucugacaauaaggcucagaugaaaaaccuguauggcgauuccaauccgcaaaaguuuaccagcucugccaacggggugacaacccauuacgugucccagaucggaggcuucccugaccagacggaggauggcgggcucccccagagcggacgcauugucguggacuauaugguucaaaagccuggcaaaacagggaccaucguguaccagagaggaauccugcuuccccagaaggucuggugcgcuucuggccgguccaaagugauuaaggggagccugccccucaucggagaggccgauugucugcacgaaaaauauggcggccugaacaaguccaaaccuuacuacaccggggagcacgcgaaggccauuggaaauugcccgaucuggguuaagacaccccucaaacuggcuaacggcaccaaguaucgcccucccgccaaacuucugaaggaaagaggguuuuucggagcuauugccggcuuucucgaagggggcugggagggaaugaucgccggcuggcauggguacacaucucacggagcucauggcguggcggucgccgcugaccugaaaagcacgcaggaggccaucaauaagauuaccaagaaccuuaauucccugagcgagcucgaagugaaaaaccugcaacggcugucuggggccauggaugagcuccacaaugaaauccuggagcuugacgagaaggucgacgaucugcgcgcugacacaauuuccagccagaucgaacucgccgugcugcuuucuaacgagggaauuaucaauagcgaagaugagcaucugcucgcgcuggaaagaaaacugaagaaaaugcucggcccuuccgcuguugacaucgggaacggcuguuucgagaccaagcacaagugcaaucagacaugccuggaucggauugccgccggaaccuuuaacgcuggcgaguucucucuucccacguuugacagccugaauaucaccgccgcuucccucaacgaugacgggcuggauaaucacacaauucugcuuuauuacagcaccgccgcgucuucccucgccgugacacugaugaucgcuauuuucaucgucuauauggugagcagagacaacguuucuuguuccauuugccuguga

SEQ ID NO: 209527 - RNA, 1755 nt, Artificial Sequence; identical to SEQ ID NO: 209525
  derived and/or modified sequence opt5 from hemagglutinin__InfluenzaB__ABN50712

SEQ ID NO: 209528 - RNA, 1755 nt, Artificial Sequence
  derived and/or modified sequence opt5 from hemagglutinin__InfluenzaB__ABN50723
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuucggggcacgaaaacccgcgggaagcugugucccacaugccucaacuguaccgaucuggacguggcucuuggaagaccuaugugcgucggcacaacccccucugccaaagccagcauucugcacgaagugcggccuguuacguccggguguuuucccaucaugcaugaucgcacaaagaucagacaacucccuaaucugcugcggggauacgagaagauucgccucucuacccagaacgugaucaaugcugaaaaagccccgggcggccccuauagacuggggacaagcggauccugcccuaacgcuaccagccggucuggcuucuuugccaccauggcgugggccgucccccgcgacaauaacaagacagcuacgaauccucuuaccguggaggugcccuacauuuguacaaaagaagaggaucagaucaccgucuggggguuccacuccgacaacaagacacagaugaaaaaucuguauggagauagcaacccgcaaaaguuuaccucuuccgccaauggcguuacgacacauuacgugagccagauugggggauucccugaccagaccgaggauggcggccucccccagucugggagaaucguggucgacuauauggugcaaaagccuggaaaaaccggcacaauuguuuaccagcgggggauccugcuuccccagaagguguggugcgcuuccggacgcagcaaagucaucaagggcucccugccccucauuggggaagccgauugucugcacgagaaauauggaggccugaacaagucuaaaccuuacuacaccggcgaacacgcgaaggccaucgggaacugcccgauuugggugaagacaccccucaaacuggcuaauggaacgaaguauagaccucccgccaaacuucugaaggagcggggcuuuuucggggcuaucgccggauuucucgagggcgggugggaaggcaugauugccggauggcauggcuacaccagccacggggcucauggaguugcgguggccgcugaccugaaauccacacaggaggccaucaacaagaucaccaagaaucuuaacagccugucugaacucgaggucaaaaaucugcaacgccuguccggcgccauggaugaacuccacaacgagauucuggagcuugacgaaaagguggacgaucugagagcugacacaaucagcucucagauugagcucgccguccugcuuagcaaugaagggaucauuaacuccgaggaugaacaucugcucgcgcuggagcggaaacugaagaaaaugcucggaccuucugcuguggacaucggcaauggguguuucgagaccaagcacaagugcaaccagacgugccuggauagaaucgccgccggcaccuuuaaugcuggagaguucagccuucccacauuugacucccugaacauuaccgccgcuagccucaaugaugacggccuggauaaccacacaauccugcuuuauuacucuaccgccgcguccagccucgccguuacgcugaugauugcuaucuucauuguguauaugaucucucgcgacaaugucuccuguagcauuugccuguga

SEQ ID NO: 209529 - RNA, 1755 nt, Artificial Sequence
  derived and/or modified sequence opt5 from hemagglutinin__InfluenzaB__ABN50734
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcagaucuggcuucuuuaccaccauggcgugggccgugccccgggacaauaacaaaacagcuacgaauccucuuaccgucgaggugccccacaucuguacaaaggaagaggaucagauuaccguguggggguuccauuccgacgauaaaacacagaugaagaaccuguacggagacagcaauccgcaaaaguuuaccucuuccacgaacggcaucacaacccacuaugucagccagauugggggauucccugaucagaccgaggacggcggccucccccagucugggcgcaucguuguggauuacauggugcaaaaaccuggaaagacaggcaccaucgucuaucagagagggauucugcuuccccagaaaguguggugcgccuccggacggagcaagguuaucaaaggcucccugccccucauuggggaagcugacugucugcacgagaaguacggaggccugaauaaaucuaagccuuauuacacaggcgaacaugccaaggcgaucgggaacugcccgauuugggugaaaacgccccucaagcuggccaacggaaccaaauaccgcccucccgcuaaacuucugaaagagagaggcuuuuucggggccaucgcuggauuucucgagggcgggugggaaggcaugaucgccggauggcacggcuauacaagccauggggcccacggagucgcuguggcggccgaucugaaguccacccaggaggcuauuaauaagaucacaaagaaccuuaauagccugucugaacucgagguuaagaaccugcaacggcuguccggcgccauggacgaacuccacaaugagauucuggagcuugacgaaaaaguggaugaccugcgcgccgauaccaucagcucucagauugagcucgcuguccugcuuagcaacgaagggaucaucaauuccgaggacgaacaucugcucgcccuggagagaaagcugaaaaagaugcucggaccuucugcgguggauauuggcaacggguguuucgagacgaagcacaaaugcaaucagaccugccuggaccggaucgcugccggcacauuuaacgccggagaguucagccuucccaccuuugauucccugaauauuacagcugccagccucaacgacgauggccuggacaaucauaccauccugcuuuacuauucuacggcugccuccagccucgcggucacacugaugauugccaucuucauuguguacaugaucucuagagauaacguuuccuguagcaucugccuguga

SEQ ID NO: 209530 - RNA, 1758 nt, Artificial Sequence
  derived and/or modified sequence opt5 from hemagglutinin__InfluenzaB__ABN50745
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaauauuaccaacggcaauggguucuuugccacaauggcuugggccguccccaaaaacgacaauaacaagaccgcgaccaauagccugacaaucgaggugccuuacauuuguacggaaggagaggaucagaucaccguguggggcuuccacucugacaacgagacacagauggccaaacuuuauggggauuccaaaccccagaaguuuaccagcucugcuaacggagucacaacccacuacguuucccaaaucggcggcuucccgaaucagacggaagacgggggacugccucagagcggccgcauugugguggauuauaugguccagaaaucugggaagacaggaaccaucaccuaccaaagaggcauucuccugccccagaaaguguggugcgccuccgggcggagcaagguuaucaaaggaucccuuccucugauuggcgaggcugacugucuccaugaaaaguauggcgggcugaacaagucuaaacccuacuacacaggagagcacgccaaggcgaucggcaauugccccaucugggugaaaaccccucugaagcucgccaacgggacaaaauaucgcccgcccgcuaagcugcuuaaggagagaggauuuuucggcgccauugcuggguuucuggaaggcggaugggagggcaugaucgccggguggcauggauacacgagccacggcgcccacggggucgcuguggcggccgaucucaaauccacccaggaagcuauuaauaagaucacaaagaaccugaauagccuuucugagcuggaaguuaagaaccuccagcggcuguccggagccauggacgagcugcauaaugagauucucgaacuggaugagaaaguggacgaccuucgcgccgauaccaucagcucucaaaucgaacuggcuguccuccugagcaacgagggcauuaucaauuccgaagacgagcaccuucuggcccucgagagaaagcugaagaaaaugcuggggccuucugcgguggaaauuggcaacggauguuucgagacaaagcauaaaugcaaucagaccugccucgaucggaucgcugccggcacguuuaacgccggggaguucagccugcccaccuuugacucccuuaauauuacagcugccagccugaacgaugacggacucgauaaccacaccauccugcuguauuacucuacagcugccuccagccuugcggucacccucaugauugccaucuucgugguuuauauggugucucgcgacaaugucuccuguagcaucugccuguga

SEQ ID NO: 209531 - RNA, 1752 nt, Artificial Sequence
  derived and/or modified sequence opt5 from hemagglutinin__InfluenzaB__ABN51184
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagaauauucggcucucuacgcacaacguuaucaaugcugaacgcgccccgggcggccccuauagacuggggacaagcggauccugcccuaacgugaccagcaaaucuggcuucuuugcuacaauggccugggcggucccccgggacaauaagaccgccaccaacccucuuacaguggaggugcccuacauuuguacgaaaggggaagaucagaucaccgucuggggauuccauuccgacaauaagauucagaugaaaaaccuguauggcgauagcaauccgcagaaguuuacaucuuccgcuaacgggguuaccacacacuacgugagccaaaucggaggcuucccuaaccagaccgaggacggcgggcucccccagucuggacgcaucguggucgauuauauggugcagaagccuggcaaaacggggacaauuguuuaccaaagaggagugcugcuuccccagaaggucuggugcgccuccggccggagcaaagugaucaaggggucccugccccucauuggagaggcugacugucugcacgaaaaauauggcggccugaauaagucuaaaccuuacuacaccggggagcaugccaaggcgaucggaaacugcccgauuuggguuaagacaccccucaaacuggccaauggcaccaaguaucgcccucccgcuaaacuucugaaggaaagaggguuuuucggagccaucgcuggcuuucucgaagggggcugggagggaaugaucgccggcuggcacggguacaccagccauggagcccacggcguggcugucgcggccgaucugaaauccacacaggaggcuauuaacaagaucacgaagaaucuuaacagccugucugagcucgaagugaaaaaucugcagcggcuguccggggccauggacgagcuccacaacgaaauucuggagcuugaugagaaggucgacgaccugcgcgccgauaccaucagcucucaaauugaacucgcugugcugcuuagcaaugagggaaucaucaacuccgaagacgagcaucugcucgcccuggaaagaaaacugaagaaaaugcucggcccuucugcgguugauauugggaauggcuguuucgagacaaagcacaagugcaaccagaccugccuggaccggaucgcugccggaacauuuaaugccggcgaguucagccuucccaccuuugauucccugaacauuacggcugccagccucaaugacgaugggcuggacaaccauaccauccugcuuuauuacucuacagcugccuccagccucgcggugacccugaugauugccaucuucauugucuauauggugucuagagauaacguuuccuguagcaucugccuguga

SEQ ID NO: 209532 - RNA, 1752 nt, Artificial Sequence
  derived and/or modified sequence opt5 from hemagglutinin__InfluenzaB__ABN51195
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagaauauucggcucucuacgcacaacguuaucaaugcugaacgcgccccgggcggccccuauagacuggggacaagcggauccugcccuaacgugaccagccggucuggcuucuuugcuacaauggccugggcggucccccgcgacaauaaaaccgccaccaacccucuuacaguggaggugcccuacauuuguacgaagggggaagaucagaucaccgucuggggauuccauuuugacaauaaaauucagaugaagaaccuguauggcgauuccaauccgcagaaauucacaagcucugcuaacgggguuaccacacacuacgugucccaaaucggaggcuuuccuaaccagaccgaggacggcgggcucccccagagcggaagaaucguggucgauuauauggugcagaagccuggcaagacggggacaauuguuuaccaacggggagugcugcuuccccagaaagucuggugcgccucuggccgcuccaaggugaucaaagggagccugccccucauuggagaggcugacugucugcacgaaaaguauggcggccugaauaaauccaagccuuacuacaccggggagcaugccaaagcgaucggaaacugcccgauuuggguuaagacaccccucaagcuggccaauggcaccaaauauagaccucccgcuaagcugcugaaagaacggggguucuuuggagccaucgcuggcuuccucgaagggggcugggagggaaugaucgccggcuggcacggguacaccucucauggagcccacggcguggcugucgcggccgaucuuaagagcacacaggaggcuauuaacaaaaucacgaagaaucuuaacucccugagcgagcucgaagugaagaaucugcagcgccugucuggggccauggacgagcuccacaacgaaauucuggagcuugaugagaaagucgacgaccugagagccgauaccaucuccagccaaauugaacucgcugugcugcuuucuaaugagggaaucaucaacagcgaagacgagcaucugcucgcccuggaacggaagcugaaaaagaugcucggcccuuccgcgguugauauugggaauggcuguuuugagacaaaacacaagugcaaccagaccugccuggacagaaucgcugccggaacauucaaugccggcgaguuuucucuucccaccuucgauagccugaacauuacggcugccucccucaaugacgaugggcuggacaaccauaccauccugcuuuauuacagcacagcugccucuucccucgcggugacccugaugauugccaucuucauugucuauauggugagccgcgauaacguuucuuguuccaucugccuguga

SEQ ID NO: 209533 - RNA, 1758 nt, Artificial Sequence
  derived and/or modified sequence opt5 from hemagglutinin__InfluenzaB__ABN58661
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcacaauucccucugccaaagucagcauccugcacgaagugaagccuguuaccuccggguguuuucccaucaugcaugauagaacgaaaauucggcaacucccuaaucugcugcgcggauacgagcacaucagacucucuacacauaacgugauuaaugccgaaaaggcuccgggcggccccuauaaaaucgggaccagcggauccugcccuaacgucacaaauggcaacggguucuuugccaccauggcuugggccgugcccaagaaugacaacaauaagaccgcgacaaacagccugacgguggaggucccuuacauuuguaccgaaggagaggaucagaucacaguuuggggcuuccacucugacaaugagacccagauggccaaacuuuauggggauuccaagccccagaaauuuacaagcucugcuaacggagugaccacgcacuacgugucccaaauuggcggcuucccgaaccaggccgaagacgggggacugccucagagcggccggaucgucguggauuauaugguucagaagucugggaaaacaggaaccaucaccuaccaacgcggcauucuccugccccagaagguguggugcgcuuccgggagaagcaaagucaucaagggaucccuuccucugauuggcgaggccgacugucuccaugaaaaguauggcgggcugaauaaaucuaagcccuacuacacaggagagcacgcgaaagccaucggcaacugccccauuugggugaagaccccucugaaacucgcuaaugggacaaaguaucggccgcccgccaagcugcuuaaagagcgcggauuuuucggcgcuaucgccggguuucuggaaggcggaugggagggcaugaucgccggguggcauggauacacgagccacggcgcucacgggguugcgguggccgcugaucucaaguccacccaggaagccauuaacaaaaucacaaagaaucugaacagccuuucugagcuggaagucaaaaaucuccagagacuguccggagccauggacgagcugcauaacgagauucucgaacuggaugagaagguggacgaccuucgggcugauaccaucagcucucaaauugaacuggccguccuccugagcaaugagggcaucaucaacuccgaagacgagcaccuucuggcgcucgagcgcaagcugaaaaagaugcuggggccuucugcuguggaaauuggcaauggauguuucgagacaaaacauaagugcaaccagaccugccucgauagaaucgccgccggcacguuuaaugcuggggaguucagccugcccaccuuugacucccuuaacauuacagccgcuagccugaaugaugacggacucgauaaccacaccauccugcuguauuacucuacagccgcguccagccuugccguuacccucaugauugcuaucuucauuguguauauggucucucgggacaacguguccuguagcaucugccuguga

SEQ ID NO: 209534 - RNA, 1755 nt, Artificial Sequence; identical to SEQ ID NO: 209422
  derived and/or modified sequence opt5 from hemagglutinin__InfluenzaB__ABN59445

SEQ ID NO: 209535 - RNA, 1755 nt, Artificial Sequence
  derived and/or modified sequence opt5 from hemagglutinin__InfluenzaB__ABO72377
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugcuuuaacuguaccgaucucgacguugcccugggacgcccuaugugcgugggcauuacacccucugccaaggcuagcauccuucacgaagucagaccugugaccuccggguguuuccccaucaugcaugaucggacgaagauucgccaacugccuaaucuccugagaggauacgagaaaauccggcugucuacacagaacguuauugacgccgaaaaggcuccgggcggccccuaucgccucgggaccagcggauccugcccuaaugccacaagcaaaucuggcuuuuucgcgaccauggccugggcugugcccagagauaacaauaagaccgccacaaacccucugacggucgaggugccccacaucuguaccaaagaagaggaccagauuacaguguggggguuucauuccgauaauaagacccagaugaagaaccuuuacggagacagcaauccgcaaaaauucacaucuuccgcuaacggcaucaccacgcacuaugucagccagauugggggauuuccugaucagacagaggacggcggccugccccagucugggcggaucguuguggauuacauggugcaaaagccuggaaaaaccggcaccaucgucuaucagcgcgggauucuccugccccagaagguguggugcgccuccggaagaagcaaaguuaucaagggcucccuuccccugauuggggaagcggacugucuccacgagaaauacggaggccugaauaagucuaagccuuauuacacaggcgaacaugccaaagcuaucgggaacugcccgauuugggugaagacaccccugaaacucgccaacggaaccaaguaccggccucccgcuaaacugcuuaaggagcgcggcuucuuuggggccaucgccggauuccuggagggcgggugggaaggcaugaucgcuggauggcacggcuauacgagccauggggcgcacggagucgccguggcugccgaucucaaguccacccaggaggccauuaauaaaaucacaaagaaccugaauagccuuucugaacuggagguuaaaaaccuccaaagacuguccggcgcuauggacgaacugcacaaugagauucucgagcuggacgaaaagguggaugaccuucgggccgauaccaucagcucucagauugagcuggcgguccuccugagcaacgaagggaucaucaauuccgaggacgaacaucuucuggcucucgagcgcaaacugaagaagaugcugggaccuucugccguggauauuggcaacggguguuuugagacaaaacacaagugcaaucagaccugccucgacagaaucgccgcuggcacguucaacgccggagaauuuagccugcccaccuucgauucccuuaauauuacagcugccagccugaacgacgauggccucgacaaucauaccauccugcuguacuauucuacagcggccuccagccuugcugucacccucaugauugccaucuucauuguguacaugaucucucgggauaacguuuccuguagcaucugccuguga

SEQ ID NO: 209536 - RNA, 1755 nt, Artificial Sequence; identical to SEQ ID NO: 209429
  derived and/or modified sequence opt5 from hemagglutinin__InfluenzaB__ABR15973

SEQ ID NO: 209537 - RNA, 1752 nt, Artificial Sequence
  derived and/or modified sequence opt5 from hemagglutinin__InfluenzaB__ABR15995
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaucacccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacuauaaaacacagaugaagaaccuguacggcgauagcaauccgcagaaauuuaccucuuccgcuaacgggauuacaacccacuauguuagccaaaucggaggcuucccuaaucagacggaggacggcgggcucccccagucuggaagaaucgugguggauuacaugguccagaagccuggcaagacagggaccauuguguaucaacggggaguucugcuuccccagaaaguguggugcgccuccggccgcagcaaggucaucaaagggucccugccccucauuggagaggcugacugucugcaugaaaaguacggcggccugaacaaaucuaagccuuacuauaccggggagcacgccaaagcgaucggaaacugcccgauuugggugaagacaccccucaagcuggccaauggcaccaaauacagaccucccgcuaagcugcugaaagaacggggguuuuucggagccaucgcuggcuuucucgaagggggcugggagggaaugaucgccggcuggcauggguauacaagccacggagcccacggcguugcuguggcggccgaucugaaguccacgcaggaggcuauuaacaaaaucaccaagaaucuuaacagccugucugagcucgaagucaagaaucugcagcgccuguccggggccauggacgagcuccauaacgaaauucuggagcuugaugagaaaguggacgaccugagagccgauacaaucagcucucaaauugaacucgcuguccugcuuagcaaugagggaaucaucaacuccgaagacgagcaccuucucgcccuggaacggaagcugaaaaagaugcucggcccuucugcgguggauauugggaauggcuguuucgagaccaaacauaagugcaaccagacaugccuggacagaaucgcugccggaaccuuuaaugccggcgaguucagccuucccacguuugauucccugaacauuaccgcugccagccucaaugacgaugggcuggacaaccacacaauccugcuuuacuauucuaccgcugccuccagccucgcgguuacacugaugauugccaucuucauuguguacauggucucucgcgauaauguguccuguagcaucugccuguga

SEQ ID NO: 209538 - RNA, 1758 nt, Artificial Sequence
  derived and/or modified sequence opt5 from hemagglutinin__InfluenzaB__ABR16017
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauguguccuguagcaucugccuguga

SEQ ID NO: 209539 - RNA, 1758 nt, Artificial Sequence; identical to SEQ ID NO: 209538
  derived and/or modified sequence opt5 from hemagglutinin__InfluenzaB__ACA64899

SEQ ID NO: 209540 - RNA, 1758 nt, Artificial Sequence
  derived and/or modified sequence opt5 from hemagglutinin__InfluenzaB__ACA64932
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugccucaacuguacagaucuggacguggcgcuuggacgcccuaagugcaccggcaauauucccagcgcuagagucuccauccugcacgaggugcggccuguuacaucuggguguuuucccaucaugcaugaucgcaccaagauuagacaacucccuaaccugcugcggggauacgaacacauccgccucagcacgcauaaugugauuaacgccgagaaugccccgggcggccccuauaaaaucgggacauccggaagcugcccuaacgucaccaauggcaacggguucuuugcuacaauggccugggcugugcccaagaaugacauuaacaaaaccgccaccaauucucugacaaucgaagugccuuacauuuguacggagggagaggaucagaucaccgucuggggcuuccacuccgacaacgaaacacagauggcgaagcuguauggggauagcaaaccccagaaguuuaccucuuccgccaacggaguuacaacccacuacgugagccaaaucggcggcuucccgaaucagacggaggacgggggacugccucagucuggcagaauuguggucgauuauauggugcagaaguccgggaaaacaggaaccaucaccuaccaacggggcauucuccugccccagaagguuuggugcgcuagcgggcgcuccaaagugaucaagggaucucuuccucugauuggcgaagccgacugucuccaugagaaauauggcgggcugaacaagagcaaacccuacuacacaggagagcacgcuaaggccaucggcaauugccccaucugggucaagaccccucugaaacucgcgaacgggacaaaguauagaccgcccgccaaacugcuuaaggaacggggauuuuucggcgcuauugccggguuucuggagggcggaugggaaggcaugaucgcuggguggcauggauacacgucccacggcgcccacgggguggccguugcugcggaucucaaaagcacccaggaggccauuaauaagaucacaaagaaccuuaauucucuuuccgaacuggaggugaaaaaccuccagcgccugagcggagcuauggacgagcugcauaaugaaauucucgagcuggaugaaaaggucgacgaccuuagagccgauaccaucucuagccaaaucgagcuggccgugcuccuguccaacgaaggcauuaucaauucugaggacgagcaccuucuggcucucgaacggaaacugaagaaaaugcuggggccuagcgccgucgagauuggcaacggauguuucgaaacaaagcauaagugcaaucagaccugccucgauaaaaucgcggcuggcacguuugacgccggggaguucucccugcccaccuuugauagccuuaacauuacagccgcuucucugaaugacgauggacucgacaaccacaccauccugcuguauuacuccacagccgcuagcucucuugccgugacccucaugauugcgaucuucguuguguauauggucucccgcgauaacgugagcuguuccaucugccuguga

SEQ ID NO: 209541 - RNA, 1758 nt, Artificial Sequence; identical to SEQ ID NO: 209538
  derived and/or modified sequence opt5 from hemagglutinin__InfluenzaB__ACA64943

SEQ ID NO: 209542 - RNA, 1758 nt, Artificial Sequence
  derived and/or modified sequence opt5 from hemagglutinin__InfluenzaB__ACA64954
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccagcucucugacaauugaagugccuuacaucuguacggagggagaggaucagauuaccgucuggggcuuccacuccgacaacgaaacacagauggccaagcuguauggggauagcaaaccccagaaguuuaccucuuccgcuaacggaguuacaacccacuacgugagccaaaucggcggcuucccgaaucagacggaggacgggggacugccucagucuggcagaaucguggucgauuauauggugcagaaguccgggaaaacaggaaccauuaccuaccaacggggcauccuccugccccagaagguuuggugcgccagcgggcgcuccaaagugauuaagggaucucuuccucugaucggcgaagcugacugucuccaugagaaauauggcgggcugaacaagagcaaacccuacuacacaggagagcacgccaaggcgauuggcaauugccccaucugggucaagaccccucugaaacucgccaacgggacaaaguauagaccgcccgcuaaacugcuuaaggaacggggauuuuucggcgccaucgcuggguuucuggagggcggaugggaaggcaugauugccggguggcauggauacacgucccacggcgcccacgggguggcuguugcggccgaucucaaaagcacccaggaggcuaucaauaagauuacaaagaaccuuaauucucuuuccgaacuggaggugaaaaaccuccagcgccugagcggagccauggacgagcugcauaaugaaauccucgagcuggaugaaaaggucgacgaccuuagagccgauaccauuucuagccaaaucgagcuggcugugcuccuguccaacgaaggcaucauuaauucugaggacgagcaccuucuggcccucgaacggaaacugaagaaaaugcuggggccuagcgcggucgagaucggcaacggauguuucgaaacaaagcauaagugcaaucagaccugccucgaucgcauugcugccggcacguuugacgccggggaguucucccugcccaccuuugauagccuuaacaucacagcugccucucugaaugacgauggacucgacaaccacaccauucugcuguauuacuccacagcugccagcucucuugcggugacccucaugaucgccauuuucguuguguauauggucuccagagauaacgugagcuguuccaucugccuguga

SEQ ID NO: 209543 - RNA, 1758 nt, Artificial Sequence; identical to SEQ ID NO: 209538
  derived and/or modified sequence opt5 from hemagglutinin__InfluenzaB__ACA64965

SEQ ID NO: 209544 - RNA, 1758 nt, Artificial Sequence
  derived and/or modified sequence opt5 from hemagglutinin__InfluenzaB__ACA64998
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcuuuaacuguacagaucucgacguggcucugggacgcccuaagugcaccggcaauauucccucugccagagucagcauccuucacgaggugcggccuguuacauccggguguuuccccaucaugcaugaucgcaccaagauuagacaacugccuaaccuccugcggggauacgaacacauccgccugucuacgcauaaugugauuaacgccgagaaugcuccgggcggccccuauaaaaucgggacaagcggauccugcccuaacgucaccaauggcaacggguuuuucgccacaauggcuugggccgugcccaagaaugacaacaauaaaaccgcgaccaacagccucacaauugaagugccuuacaucuguacggagggagaggaucagauuaccgucuggggcuuucacucugacaacgaaacacagauggccaagcuguauggggauuccaaaccccagaaguucaccagcucugcuaauggaguuacaacccacuacgugucccaaaucggcggcuuuccgaaccagacggaggacgggggacuuccucagagcggcagaaucguggucgauuauauggugcagaagucugggaaaacaggaaccauuaccuaccaacggggcauccugcucccccagaagguuuggugcgccuccgggcgcagcaaagugauuaagggaucccugccucuuaucggcgaagcugacugucugcaugagaaauauggcgggcucaauaagucuaaacccuacuacacaggagagcacgccaaggcgauuggcaacugccccaucugggucaagaccccucugaaacuggccaaugggacaaaguauagaccgcccgcuaaacuccugaaggaacggggauucuuuggcgccaucgcuggguuccuugagggcggaugggaaggcaugauugccggguggcauggauacacgagccacggcgcccacgggguggcuguugcggccgaucugaaauccacccaggaggcuaucaacaagauuacaaagaaucucaacagccugucugaacuugaggugaaaaaucugcagcgccucuccggagccauggacgagcugcauaacgaaauccuggagcucgaugaaaaggucgacgaccugagagccgauaccauuagcucucaaaucgagcuugcugugcugcucagcaaugaaggcaucauuaacuccgaggacgagcaucugcuugcccuggaacggaaacucaagaaaaugcuggggccuucugcggucgagaucggcaauggauguuuugaaacaaagcacaagugcaaccagaccugccuggaucgcauugcugccggcacguucgacgccggggaguuuagccuccccaccuucgauucccugaauaucacagcugccagccuuaacgacgauggacuggacaaccacaccauucuccuguauuacucuacagcugccuccagccuggcggugacccuuaugaucgccauuuucguuguguauauggucucuagagauaauguguccuguagcaucugccucuga

SEQ ID NO: 209545 - RNA, 1758 nt, Artificial Sequence
  derived and/or modified sequence opt5 from hemagglutinin__InfluenzaB__ACA65020
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugccucaacuguacagaucuggacguggcgcuuggacgcccuaagugcaccggcaauauucccagcgcuagagucuccauccugcacgaggugcggccuguuacaucuggguguuuucccaucaugcaugaucgcaccaagauuagacaacucccuaaccugcugcggggauacgaacacauccgccucagcacgcauaaugugauuaacgccgagaaugccccgggcggccccuauaaaaucgggacauccggaagcugcccuaacgucaccaauggcaacggguucuuugcuacaauggccugggcugugcccaagaaugacaacaauaaaaccgccaccaacucucugacaauugaagugccuuacaucuguacggagggagaggaucagauuaccaucuggggcuuccacuccgacaacgaaacacagauggcgaaacuuuauggggauagcaagccccagaaguuuaccucuuccgccaauggagucacaacccacuacguuagccaaaucggcggcuucccgaaccagacggaggacgggggacugccucagucuggcagaauugugguggauuauaugguccagaaguccgggaaaacaggaaccaucaccuaccaacggggcauucuccugccccagaagguguggugcgcuagcgggcgcuccaaaguuaucaagggaucucuuccucugauuggcgaagccgacugucuccaugagaaauauggcgggcugaauaagagcaaacccuacuacacaggagagcacgcuaaggccaucggcaacugccccaucugggugaagaccccucugaaacucgcgaaugggacaaaguauagaccgcccgccaaacugcuuaaggaacggggauuuuucggcgcuauugccggguuucuggagggcggaugggaaggcaugaucgcuggguggcauggauacacgucccacggcgcccacggggucgccguggcugcggaucucaaaagcacccaggaggccauuaacaagaucacaaagaaucugaacucucuuuccgaacuggagguuaaaaaucuccagcgccugagcggagcuauggacgagcugcauaacgaaauucucgagcuggaugaaaagguggacgaccuuagagccgauaccaucucuagccaaaucgagcuggccguccuccuguccaaugaaggcauuaucaacucugaggacgagcaccuucuggcucucgaacggaaacugaagaaaaugcuggggccuagcgccguggaggucggcaauggauguuucgaaacaaagcauaagugcaaccagaccugccucgaucgcauugcggcuggcacguuugacgccggggaguucucccugcccaccuuugauagccuuaauaucacagccgcuucucugaacgacgauggacucgacaaccacaccauucugcuguauuacuccacagccgcuagcucucuugccgugacccucaugaucgcgauuuucguuguguauauggucuccagagauaaugugagcuguuccaucugccuguga

SEQ ID NO: 209546 - RNA, 1758 nt, Artificial Sequence; identical to SEQ ID NO: 209544
  derived and/or modified sequence opt5 from hemagglutinin__InfluenzaB__ACA65031

SEQ ID NO: 209547 - RNA, 1758 nt, Artificial Sequence
  derived and/or modified sequence opt5 from hemagglutinin__InfluenzaB__ACA65042
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugccucaacuguacagaucuggacguggcgcuuggacgcccuaagugcaccggcaauauucccagcgcuagagucuccauccugcacgaggugcggccuguuacaucuggguguuuucccaucaugcaugaucgcaccaagauuagacaacucccuaaccugcugcggggauacgaacacauccgccucagcacgcauaaugugauuaacgccgagaaugccccgggcggccccuauaaaaucgggacauccggaagcugcccuaacgucaccaauggcaacggguucuuugcuacaauggccugggcugugcccaagaaugacaacaauaaaaccgccaccaacucucugacaauugaagugccuuacaucuguacggagggagaggaucagauuaccgucuggggcuuccacuccgacaacgaaacacagauggcgaaacuuuauggggauagcaagccccagaaguuuaccucuuccgccaauggaguuacaacccacuacgugagccaaaucggcggcuucccgaaccagacggaggacgggggacugccucagucuggcagaaucauuguggauuauaugguccagaaguccgggaaaacaggaaccaucaccuaccaacggggcauucuccugccccagaagguguggugcgcuagcgggcgcuccaaaguuaucaagggaucucuuccucugauuggcgaagccgacugucuccaugagaaauauggcgggcugaauaagagcaaacccuacuacacaggagagcacgcuaaggccaucggcaacugccccaucugggugaagaccccucugaaacucgcgaaugggacaaaguauagaccgcccgccaaacugcuuaaggaacggggauuuuucggcgcuauugccggguuucuggagggcggaugggaaggcaugaucgcuggguggcauggauacacgucccacggcgcccacggggucgccguggcugcggaucucaaaagcacccaggaggccauuaacaagaucacaaagaaucugaacucucuuuccgaacuggagguuaaaaaucuccagcgccugagcggagcuauggacgagcugcauaacgaaauucucgagcuggaugaaaagguggacgaccuuagagccgauaccaucucuagccaaaucgagcuggccguccuccuguccaaugaaggcauuaucaacucugaggacgagcaccuucuggcucucgaacggaaacugaagaaaaugcuggggccuagcgccguggagauuggcaauggauguuucgaaacaaagcauaagugcaaccagaccugccucgaucgcaucgcggcuggcacguuugacgccggggaguucucccugcccaccuuugauagccuuaauauuacagccgcuucucugaacgacgauggacucgacaaccacaccauccugcuguauuacuccacagccgcuagcucucuugccgucacccucaugauugcgaucuucgugguuuauaugguguccagagauaaugucagcuguuccaucugccuguga

SEQ ID NO: 209548 - RNA, 1758 nt, Artificial Sequence
  derived and/or modified sequence opt5 from hemagglutinin__InfluenzaB__ACA65053
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgagaaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccauucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggccggaucguggucgauuauauggugcagaagucugggaaaacaggaaccauuaccuaccaacgcggcauccuccugccccagaagguuuggugcgccuccgggagaagcaaagugauuaagggaucccuuccucugaucggcgaagcugacugucuccacgagaaauauggcgggcugaauaagucuaaacccuacuacacaggagagcaugccaaggcgauuggcaacugccccaucugggucaagaccccucugaaacucgccaaugggacaaaguaucggccgcccgcuaaacugcuuaaggaacgcggauuuuucggcgccaucgcuggguuucuggagggcggaugggaaggcaugauugccggguggcacggauacacgagccauggcgcccacgggguggcuguugcggccgaucucaaauccacccaggaggcuaucaacaagauuacaaagaaucugaacagccuuucugaacuggaggugaaaaaucuccagagacuguccggagccauggacgagcugcacaacgaaauccucgagcuggaugaaaaggucgacgaccuucgggccgauaccauuagcucucaaaucgagcuggcugugcuccugagcaaugaaggcaucauuaacuccgaggacgagcaucuucuggcccucgaacgcaaacugaagaaaaugcuggggccuucugcggucgagaucggcaauggauguuucgaaacaaagcacaagugcaaccagaccugccucgauagaauugcugccggcacguuugacgccggggaguucagccugcccaccuuugauucccuuaauaucacagcugccagccugaacgacgauggacucgacaaccauaccauucugcuguauuacucuacagcugccuccagccuugcggugacccucaugaucgccauuuucguuguguauauggucucucgggauaauguguccuguagcaucugccuguga

SEQ ID NO: 209549 - RNA, 1758 nt, Artificial Sequence
  derived and/or modified sequence opt5 from hemagglutinin__InfluenzaB__ACA65075
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacauuaccaauggcaacggguucuuugccacaauggcuugggccguccccaagaaugacaacaauaaaaccgcgaccaacagccugacaaucgaagugccuuacauuuguacggagggagaggaucagaucaccguguggggcuuccacucugacaacgaaacacagauggccaaacuuuauggggauuccaagccccagaaguuuaccagcucugcuaauggagucacaacccacuacguuucccaaaucggcggcuucccgaaccagacggaggacgggggacugccucagagcggcagaauugugguggauuauaugguccagaagucugggaaaacaggaaccaucaccuaccaacggggcauucuccugccccagaagguguggugcgccuccgggcgcagcaaaguuaucaagggaucccuuccucugauuggcgaagcugacugucuccaugagaaauauggcgggcugaauaagucuaaacccuacuacacaggagagcacgccaaggcgaucggcaacugccccaucugggugaagaccccucugacacucgccaaugggacgaaauauagaccgcccgcuaagcugcuuaaagaacggggauuuuucggcgccauugcuggguuucuggagggcggaugggaaggcaugaucgccggguggcauggauacaccagccacggcgcccacggggucgcuguggcggccgaucucaaguccacacaggaggcuauuaacaaaaucaccaagaaucugaacagccuuucugaacuggagguuaagaaucuccagcgccuguccggagccauggacgagcugcauaacgaaauucucgagcuggaugaaaaaguggacgaccuuagagccgauacaaucagcucucaaaucgagcuggcuguccuccugagcaaugaaggcauuaucaacuccgaggacgagcaccuucuggcccucgaacggaagcugaaaaagaugcuggggccuucugcgguggagauuggcaauggauguuucgaaaccaaacauaagugcaaccagacgugccucgaucgcaucgcugccggcaccuuugacgccggggaguucagccugcccacauuugauucccuuaauauuaccgcugccagccugaacgacgauggacucgacaaccacacaauccugcuguauuacucuaccgcugccuccagccuugcggucacgcucaugauugccaucuucgugguuuauauggugucuagagauaaugucuccuguagcaucugccuguga

SEQ ID NO: 209550 - RNA, 1758 nt, Artificial Sequence; identical to SEQ ID NO: 209538
  derived and/or modified sequence opt5 from hemagglutinin__InfluenzaB__ACA65086

SEQ ID NO: 209551 - RNA, 1758 nt, Artificial Sequence; identical to SEQ ID NO: 209538
  derived and/or modified sequence opt5 from hemagglutinin__InfluenzaB__ACA65097

SEQ ID NO: 209552 - RNA, 1758 nt, Artificial Sequence; identical to SEQ ID NO: 209538
  derived and/or modified sequence opt5 from hemagglutinin__InfluenzaB__ACA96552

SEQ ID NO: 209553 - RNA, 1758 nt, Artificial Sequence; identical to SEQ ID NO: 209538
  derived and/or modified sequence opt5 from hemagglutinin__InfluenzaB__ACA96563

SEQ ID NO: 209554 - RNA, 1758 nt, Artificial Sequence; identical to SEQ ID NO: 209538
  derived and/or modified sequence opt5 from hemagglutinin__InfluenzaB__ACA96574

SEQ ID NO: 209555 - RNA, 1758 nt, Artificial Sequence; identical to SEQ ID NO: 209538
  derived and/or modified sequence opt5 from hemagglutinin__InfluenzaB__ACA96585

SEQ ID NO: 209556 - RNA, 1758 nt, Artificial Sequence
  derived and/or modified sequence opt5 from hemagglutinin__InfluenzaB__ACA96596
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucgacaagauuacaaagaaccugaauagccuuucugaacuggaggugaaaaaccuccagcgccuguccggagccauggaugagcugcauaaugaaauccucgagcuggacgaaaaggucgacgaucuuagagccgacaccauuagcucucaaaucgagcuggcugugcuccugagcaacgaaggcaucauuaauuccgaggaugagcaccuucuggcccucgaacggaaacugaagaaaaugcuggggccuucugcggucgagaucggcaacggauguuucgaaacaaagcauaagugcaaucagaccugccucgaccgcauugcugccggcacguuugaugccggggaguucagccugcccaccuuugacucccuuaacaucacagcugccagccugaaugaugacggacucgauaaccacaccauucugcuguauuacucuacagcugccuccagccuugcggugacccucaugaucgccauuuucguuguguauauggucucuagagacaacguguccuguagcaucugccuguga

SEQ ID NO: 209557 - RNA, 1758 nt, Artificial Sequence; identical to SEQ ID NO: 209538
  derived and/or modified sequence opt5 from hemagglutinin__InfluenzaB__ACA96607

SEQ ID NO: 209558 - RNA, 1758 nt, Artificial Sequence
  derived and/or modified sequence opt5 from hemagglutinin__InfluenzaB__ACA96618
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucuuucugcccaccuucgauagccuuaauaucacagcugccucccugaacgacgauggacucgacaaccacaccauucugcuguauuacagcacagcugccucuucccuugcggugacccucaugaucgccauuuucguuguguauauggucagcagagauaaugugucuuguuccaucugccuguga

SEQ ID NO: 209559 - RNA, 1758 nt, Artificial Sequence; identical to SEQ ID NO: 209538
  derived and/or modified sequence opt5 from hemagglutinin__InfluenzaB__ACA96629

SEQ ID NO: 209560 - RNA, 1758 nt, Artificial Sequence; identical to SEQ ID NO: 209544
  derived and/or modified sequence opt5 from hemagglutinin__InfluenzaB__ACA96640

SEQ ID NO: 209561 - RNA, 1755 nt, Artificial Sequence
  derived and/or modified sequence opt5 from hemagglutinin__InfluenzaB__ACD56566
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaauguggucgaugcugaaaacgccccgggcggccccuacagacuggggaccagcggauccugcccuaaugcuacaagcaagucuggcuucuuugccaccauggcgugggccgugcccaaagacaacaauaagaacgcuaccaauccucuuacaguggagguccccuauguuuguacggaaggggaggaucagaucaccguguggggauuccauuccgacaacaaaacacagaugaagaaucuguacggcgauagcaacccgcaaaaauuuaccucuuccgccaacggggugacaacccacuaugucagccagauuggaggcuucccugcucagacggaggacggcgggcucccccagucuggacggaucgugguugauuacauggugcaaaagccucgcaagacaggcaccauugucuaucagagaggggugcugcuuccccagaaaguuuggugcgccuccggacggagcaaggugaucaaaggcucccugccccucauuggggaagcggacugucugcaugagaaguacggaggccugaauaaaucuaagccuuacuauaccggcgaacacgccaaagcuaucgggaacugcccgaucugggucaagacaccccucaagcuggccaauggaaccaaauaccgcccucccgcuaagcugcugaaagagagaggcuuuuucggggccauugccggauuucucgagggcgggugggaaggcaugaucgcuggauggcacggcuauacaagccauggggcgcacggaguggccgucgcugccgaucugaaguccacgcaggaggccauuaacaaaaucaccaagaaucuuaacagccugucugaacucgaggugaagaaucugcaacggcuguccggcgcuauggacgaacuccauaacgagauucuggagcuugacgaaaaaguugaugaccugcgcgccgauacaaucagcucucagaucgagcucgcggugcugcuuagcaaugaagggauuaucaacuccgaggacgaacaccuucucgcucuggagagaaagcugaaaaagaugcucggaccuucugccgucgauauuggcaauggguguuucgagaccaaacacaagugcaaccagacaugccuggacaagaucgccgcuggcaccuuuaaugccggagaguucagccuucccacguuugauucccugaacauuaccgcugccagccucaaugacgauggccuggacaaccauacaauccugcuuuacuauucuaccgcggccuccagccucgcugugacacugaugcuggccaucuucauuguuuacauggugucucgggauaacgucuccuguagcaucugccucuga

SEQ ID NO: 209562 - RNA, 1755 nt, Artificial Sequence
  derived and/or modified sequence opt5 from hemagglutinin__InfluenzaB__ACD56577
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuauauuuguacggaaggggaggaucagaucaccgucuggggauuccauuccgacaacaaagcccagaugaagaaucuguacggcgauagcaacccgcaaaaauuuacaucuuccgcuaacgggguuaccacacacuaugugagccagauuggaggcuucccugcccagaccgaggacggcgggcucccccagucuggacggaucguggucgauuacauggugcaaaagccucgcaagacgggcacaauuguuuaucagagaggggugcugcuuccccagaaagucuggugcgcguccggacggagcaaggugaucaaaggcucccugccccucaucggggaagccgacugucugcaugagaaguacggaggccugaauaaaucuaagccuuacuauaccggcgaacacgcuaaagccauugggaacugcccgaucuggguuaagacaccccucaagcuggcuaauggaaccaaauaccgcccucccgccaagcugcugaaagagagaggcuuuuucggggccauugcuggauuucucgagggcgggugggaaggcaugaucgcgggauggcacggcuauaccagccauggggcccacggaguggcugucgccgccgaucugaaguccacacaggaggcuauuaacaaaaucacgaagaaucuuaacagccugucugaacucgaggugaagaaucugcaacggcuguccggcgccauggacgaacuccauaacgagauccuggagcuugacgaaaaagucgaugaccugcgcgcggauaccauuagcucucagaucgagcucgcugugcugcuuagcaaugaagggauuaucaacuccgaggacgaacaccuucucgcccuggagagaaagcugaaaaagaugcucggaccuucugccguugauauuggcaauggguguuucgagacaaaacacaagugcaaccagaccugccuggaccggaucgcugccggcacauuuaaugcuggagaguucagccuucccaccuuugauucccugaacaucacggccgcgagccucaaugacgauggccuggacaaccauaccauucugcuuuacuauucuacagccgcuuccagccucgccgugacccugaugcuggcuaucuucauugucuacauggugucuagagauaacguuuccuguagcaucugccucuga

SEQ ID NO: 209563 - RNA, 1758 nt, Artificial Sequence; identical to SEQ ID NO: 209544
  derived and/or modified sequence opt5 from hemagglutinin__InfluenzaB__ACF41658

SEQ ID NO: 209564 - RNA, 1758 nt, Artificial Sequence
  derived and/or modified sequence opt5 from hemagglutinin__InfluenzaB__ACF54136
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacaagacacagauggccaaacuuuauggggauuccaagccccagaaguuuaccagcucugcuaauggaguuacaacccacuacgugucccaaaucggcggcuucccgaaccagacggaagacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaggcugacugucuccaugaaaaguauggcgggcugaauaaaucuaagcccuacuacacaggagagcacgccaaggcgauuggcaacugccccaucugggucaaaaccccucugaagcucgccaaugggacaaaauauagaccgcccgcuaagcugcuuaaagagcggggauuuuucggcgccaucgcuggguuucuggaaggcggaugggagggcaugauugccggguggcauggauacacgagccacggcgcccacgggguggcuguugcggccgaucucaaguccacccaggaagcuaucaacaagauuaccaaaaaucugaacagccuuucugagcuggaagugaagaaucuccagcgccuguccggagccauggacgagcugcauaacgagauccucgaacuggaugagaaagucgacgaccuuagagccgauacaauuagcucucaaaucgaacuggcugugcuccugagcaaugagggcaucauuaacuccgaagacgagcaccuucuggcccucgagcggaagcugaaaaagaugcuggggccuucugcggucgaaaucggcaauggauguuucgagacaaagcauaaaugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauaucuccuguagcaucugccuguga

SEQ ID NO: 209565 - RNA, 1758 nt, Artificial Sequence; identical to SEQ ID NO: 209538
  derived and/or modified sequence opt5 from hemagglutinin__InfluenzaB__ACF54147

SEQ ID NO: 209566 - RNA, 1755 nt, Artificial Sequence
  derived and/or modified sequence opt5 from hemagglutinin__InfluenzaB__ACF54158
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucucggcccuacuauaccggggaacacgccaaagcuauuggaaauugcccuaucugggugaagacaccgcucaagcuggccaacggcaccaaauacagacccccugcuaagcugcugaaagagcgcggguuuuucggagccauugccggcuuucucgaagggggcugggaaggaaugaucgcuggcuggcacggguauacaagccauggagcgcacggcguugccguggcugccgaccugaaguccacgcaggaggccauuaauaaaaucaccaagaaccuuaauagccugucugaacucgaggucaagaaccugcaacggcuguccggggcuauggacgaacuccauaaugagauccuggagcuugaugaaaaaguggacgaucugcgcgccgacacaauuagcucucagaucgagcucgcgguccugcuuagcaacgaaggaauuaucaauuccgaggaugaacaccuucucgcucuggagagaaagcugaaaaagaugcucggccccucugccguggacauugggaacggcuguuucgagaccaaacacaagugcaaucagacaugccuggaucggaucgccgcuggaaccuuuaacgccggcgaguucagccuuccuacguuugacucccugaauaucaccgcugccagccucaacgaugacgggcuggauaaucauacaauucugcuuuacuauucuaccgcggccuccagccucgcuguuacacugaugcuggccaucuucauuguguacauggucucuagagacaacguguccuguagcaucugccucuga

SEQ ID NO: 209567 - RNA, 1755 nt, Artificial Sequence
  derived and/or modified sequence opt5 from hemagglutinin__InfluenzaB__ACF54169
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaacaccgaugaagaaucuguacggcgauagcaacccucagaaauuuaccucuuccgccaacggggugacaacccacuaugugagccaaaucggaggcuuccccgcucagacggaggacgaaggcauuccucagucugggcggaucgucguggauuacaugguucagaagccccgcaagacaggaaccauuguguaucaaagaggcguccuccugccccagaaaguguggugcgccuccgggcggagcaagguuaucaaaggaucccuuccucugaucggcgaggcggacugucuccaugaaaaguacgggggacugaauaaaucuaagccguacuauaccggcgagcacgccaaagcuauuggcaacugccccaucugggugaagacaccucugaagcucgccaaugggaccaaauacagacccccugcuaagcugcuuaaagagcgcggauuuuucggcgccauugccggguuucuggaaggaggcugggaggggaugaucgcuggcuggcacggauauacaagccauggcgcgcacggggucgccguggcugccgaucucaaguccacgcaggaagccauuagcaaaaucaccaagaaccuuaauucucuguccgagcuggaagucaagaaccuccagcggcugagcggagcuauggacgagcugcauaaugagauccucgaacuggacgagaaaguggaugaccuucgcgccgauacaauuucuagccaaaucgaacuggcgguucuccuguccaacgagggcauuaucaauucugaagacgagcaccuucuggcucucgagagaaagcugaaaaagaugcuggggcccagcgccguggauauuggaaacggcuguuucgaaaccaaacacaagugcaaucagacaugccucgaccggaucgccgcugggaccuuuaacgccggcgaguucucccugccgacguuugauagccuuaauaucaccgcugccucucugaacgacgauggacucgacaaucauacaauucugcuguacuauuccaccgcggccagcucucuugcugucacacucaugcuggccaucuucauuguguacaugguuuccagagauaacgugagcuguuccaucugccuguga

SEQ ID NO: 209568 - RNA, 1755 nt, Artificial Sequence
  derived and/or modified sequence opt5 from hemagglutinin__InfluenzaB__ACF54180
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaacaccgaugaagaaucuguacggcgauagcaacccucagaaauuuaccucuuccgccaacggggugacaacccacuaugugagccaaaucggaggcuuccccgcucagacggaggacggcgggcucccucagucuggacggauugucguggauuacaugguucagaagccccgcaagacaggcaccaucguguaucaaagagggguccugcuuccccagaaaguguggugcgccuccggacggagcaagguuauuaaaggcucccugccucucaucggggaagcggacugucugcaugagaaguacggaggccugaauaaaucuaagccguacuauaccggcgaacacgccaaagcuaucgggaacugccccauuugggugaagacaccucucaagcuggccaauggaaccaaauacagacccccugcuaagcugcugaaagagcgcggcuuuuucggggccaucgccggauuucucgagggcgggugggaaggcaugauugcuggauggcacggcuauacaagccauggggcgcacggagucgccguggcugccgaucugaaguccacgcaggaggccaucaacaaaauuaccaagaaucuuaacagccugucugaacucgaggucaagaaucugcagcggcuguccggcgcuauggacgaacuccauaacgagauccuggagcuugacgaaaaaguggaugaccugcgcgccgauacaaucagcucucaaauugagcucgcgguucugcuuagcaaugaagggaucauuaacuccgaggacgaacaccuucucgcucuggagagaaagcugaaaaagaugcucggacccucugccguggauaucggcaauggguguuucgagaccaaacacaagugcaaccagacaugccuggaccggauugccgcuggcaccuuuaaugccggagaguucagccuuccgacguuugauucccugaacaucaccgcugccagccucaaugacgauggccuggacaaccauacaauccugcuuuacuauucuaccgcggccuccagccucgcugucacacugaugcuggccauuuucaucguguacaugguuucuagagauaacguguccuguagcauuugccucuga

SEQ ID NO: 209569 - RNA, 1755 nt, Artificial Sequence
  derived and/or modified sequence opt5 from hemagglutinin__InfluenzaB__ACF54202
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagccgguccugcccuaaugcuacaagcaagucuggauucuuugccaccauggcgugggccguccccaaagacaacaauaagaacgcuaccaauccucuuacaguggaggugcccuaugucuguacggaaggcgaggaucagauuaccguuuggggguuccauuccgacaacaaaacacagaugaagaaucuguacggagauagcaacccgcaaaaauuuaccucuuccgccaacggcgugacaacccacuaugugagccagaucgggggauucccugcucagacggaggacgaaggccucccccagucuggccgcauugucguggauuacaugguucaaaagccuagaaagacagggaccaucguguaucagcggggaguccugcuuccccagaaaguguggugcgccuccggccgcagcaagguuauuaaagggucccugccccucaucggagaggcggacugucugcaugaaaaguacggcgggcugaauaaaucuaagccuuacuauaccggagagcacgccaaagcuaucggcaacugcccgauuugggugaagacaccccucaagcuggccaauggcaccaaauacagaccucccgcuaagcugcugaaagagcggggguuuuucggagccaucgccggcuuucucgaagggggaugggagggcaugauugcuggguggcacggcuauacaagccauggagcgcacggcgucgccguggcugccgaucugaaguccacgcaggaagccaucaacaaaauuaccaagaaucuuaacagccugucugagcucgaagucaagaaucugcaacgccuguccggggcuauggacgagcuccauaacgagauccuggaacuugacgagaaaguggaugaccugagagccgauacaaucagcucucagauugaacucgcgguucugcuuagcaaugagggaaucauuaacuccgaagacgagcaccuucucgcucuggagcggaagcugaaaaagaugcucggcccuucugccguggauaucgggaauggauguuucgaaaccaaacacaagugcaaccagacaugccuggacagaauugccgcuggcaccuuuaaugccggggaguucagccuucccacguuugauucccugaacaucaccgcugccagccucaaugacgauggccuggacaaccauacaauccugcuuuacuauucuaccgcggccuccagccucgcugucacacugaugcuggccauuuucaucguguacaugguuucucgcgauaacguguccuguagcauuugccucuga

SEQ ID NO: 209570 - RNA, 1755 nt, Artificial Sequence
  derived and/or modified sequence opt5 from hemagglutinin__InfluenzaB__ACF54213
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacgauaagacacagaugaaaaaucuguacggcgacagcaacccgcaaaaguuuaccucuuccgccaaugggguuacaacccacuaugugagccagauuggaggcuucccugaucagacggaggacggcgggcucccccagucuggacggaucguggucgauuacaugaugcaaaagccuggcaaaacagggaccauuguguaucagcgcggaguucugcuuccccagaagguguggugcgcuuccggcagaagcaaagucaucaaggggucccugccccucaucggagaagccgacugucugcaugagaaauacggcggccugaacaagucuaaaccuuacuauaccggggaacacgcgaaggccauuggaaacugcccgaucugggugaagacaccccucaaacuggcuaauggcaccaaguaccggccucccgccaaacuucugaaggagcgcggguuuuucggagcuauugccggcuuucucgaagggggcugggaaggaaugaucgccggcuggcacggguauacaagccauggagcucacggcguugcgguggccgcugaccugaaauccacgcaggaggccauuaacaagaucaccaagaaucuuaacagccugucugaacucgaggucaaaaaucugcaaagacuguccggggccauggaugaacuccauaacgagauccuggagcuugacgaaaagguggaugaccugcgggcugauacaauuagcucucagaucgagcucgccguccugcuuagcaaugaaggaauuaucaacuccgagaaugaacaucugcucgcgcuggagcgcaaacugaagaaaaugcucggcccuucugcuguggacauugggaacggcuguuucgagaccaagcacaagugcaaucagacaugccuggauagaaucgccgccggaaccuuuaacgcuggcgaguucagccuucccacguuugacucccugaauaucaccgccgcuagccucaacgaugacgggcuggauaaucacacaauucugcuuuacuauucuaccgccgcguccagccucgccguuacacugaugcuggcuaucuucauuguguacauggucucucgggacaacguguccuguagcaucugccucuga

SEQ ID NO: 209571 - RNA, 1758 nt, Artificial Sequence
  derived and/or modified sequence opt5 from hemagglutinin__InfluenzaB__ACF54224
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaauuuaccucuucuuccaacggaguuacaacccacuacgugagccaaaucggcggcuucccgaaucagacggaggacgggggacugccucagucuggccgcaucguggucgauuauauggugcagaaguccgggaaaacaggaaccauuaccuaccaaagaggcauccuccugccccagaagguuuggugcgcuagcgggcgguccaaagugauuaagggaucucuuccucugaucggcgaagccgacugucuccaugagcgcuauggcgggcugaacaaaagcaagcccuacuacacaggagagcacgcuaaggccauuggcaauugccccaucugggucaaaaccccucugaagcucgcgaacgggacaaaauauagaccgcccgccaagcugcuuaaagaacggggauuuuucggcgcuaucgccggguuucuggagggcggaugggaaggcaugauugcuggguggcauggauacacgucccacggcgcccacgggguggccguugcugcggaucucaagagcacccaggaggccaucaauaagauuacaaagaaccugaauagccuuuccgaacuggaggugaagaaccuccagcgccugagcggagcuauggacgagcugcauaaugaaauccucgagcuggaugaaaaagucgacgaccuuagagccgauaccauuucuagccaaaucgagcuggccgugcuccuguccaacgaaggcaucauuaauucugaggacgagcaccuucuggcucucgaacggaagcugaaaaagaugcuggggccuagcgccgucgagaucggcaacggauguuucgaaacaaagcauaaaugcaaucagaccugccucgaucgcauugcggcuggcacguuugacgccggggaguucucccugcccaccuuugauagccuuaacaucacagccgcuucucugaaugacgauggacucgacaaccacaccauucugcuguauuacuccacagccgcuagcucucuugccgugacccucaugaucgcgauuuucguuguguauauggucuccagagauaacgugagcuguuccaucugccuguga

SEQ ID NO: 209572 - RNA, 1755 nt, Artificial Sequence
  derived and/or modified sequence opt5 from hemagglutinin__InfluenzaB__ACF54257
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauugacgccgaaaaggcuccgggcggccccuaucgccuggggaccagcggauccugcccuaaugccacaagcaaaucuggcuucuuugcgaccauggccugggcugugcccagagagaacaauaagaccgccacaaacccucuuacggucgaagugccccacaucuguaccaaagaggaggaucagauuacaguguggggguuccauuccgacaauaagccgcagaugaagaaccuguacggagauagcaauccucaaaaauuuaccucuuccgcuaacggcaucacaacccacuaugucagccagauugggggauuccccgaccagacggaagauggcggccucccucagucugggcggaucguuguggacuacauggugcaaaagcccggaaaaacaggcaccaucgucuaucagcgcgggauucugcuuccccagaagguguggugcgccuccggaagaagcaaaguuaucaagggcucccugccucucauuggggaggcggauugucugcacgaaaaauacggaggccugaauaagucuaagccguauuacaccggcgagcaugccaaagcuaucgggaacugccccauuugggugaagacaccucucaaacuggccaacggaaccaaguaccggcccccugcuaaacuucugaaggagcgcggcuuuuucggggccaucgccggauuucucgaaggcgggugggagggcaugaucgcuggauggcacggcuauacaagccauggggcgcacggagucgccguggcugccgaccugaaguccacgcaggaagccauuaauaaaaucaccaagaaccuuaauagccugucugagcucgaaguuaaaaaccugcaaagacuguccggcgcuauggaugagcuccacaaugagauucuggaacuugacgagaagguggacgaucugcgggccgacacaaucagcucucagauugaacucgcgguccugcuuagcaacgaggggaucaucaauuccgaagaugagcaucugcucgcucuggagcgcaaacugaagaagaugcucggacccucugccguggacauuggcaacggguguuucgaaaccaaacacaagugcaaucagacaugccuggauagaaucgccgcuggcaccuuuaacgccggagaguucagccuuccgacguuugacucccugaauauuaccgcugccagccucaacgaugacggccuggauaaucauacaauccugcuuuacuauucuaccgcggccuccagccucgcugucacacugaugauugccaucuucauuguguacaugaucucucgggacaacguuuccuguagcaucugccuguga

SEQ ID NO: 209573 - RNA, 1755 nt, Artificial Sequence
  derived and/or modified sequence opt5 from hemagglutinin__InfluenzaB__ACF54268
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauugacgccgaaaaggcuccgggcggccccuaucgccuggggaccagcggauccugcccuaaugccacaagcaaaucuggcuucuuugcgaccauggccugggcugugcccagagagaacaauaagaccgccacaaacccucuuacggucgaagugccccacaucuguaccaaagaggaggaucagauuacaguguggggguuccauuccgacaauaagauccagaugaagaaccuguacggagauagcaauccgcaaaaauuuaccucuuccgcuaacggcauuacaacccacuaugucagccagaucgggggauucccugaccagacggaagauggcggccucccccagucugggcggaucguuguggacuacauggugcaaaagccuggaaaaacaggcaccauugucuaucagcgcgggauccugcuuccccagaagguguggugcgccuccggaagaagcaaaguuauuaagggcucccugccccucaucggggaggcggauugucugcacgaaaaauacggaggccugaauaagucuaagccuuauuacaccggcgagcaugccaaagcuauugggaacugcccgaucugggugaagacaccccucaaacuggccaacggaaccaaguaccggccucccgcuaaacuucugaaggagcgcggcuuuuucggggccaucgccggauuucucgaaggcgggugggagggcaugauugcuggauggcacggcuauacaagccauggggcgcacggagucgccguggcugccgaccugaaguccacgcaggaagccaucaauaaaauuaccaagaaccuuaauagccugucugagcucgaaguuaaaaaccugcaaagacuguccggcgcuauggaugagcuccacaaugagauccuggaacuugacgagaagguggacgaucugcgggccgacacaauuagcucucagaucgaacucgcgguccugcuuagcaacgaggggaucauuaauuccgaagaugagcaucugcucgcucuggagcgcaaacugaagaagaugcucggaccuucugccaucgacauuggcaacggguguuucgaaaccaaacacaagugcaaucagacaugccuggauagaaucgccgcuggcaccuuuaacgccggagaguucagccuucccacguuugacucccugaauauuaccgcugccagccucaacgaugacggccuggauaaucauacaauccugcuuuacuauucuaccgcggccuccagccucgcugugacacugaugauugccaucuucaucgucuacaugauuucucgggacaacguguccuguagcaucugccuguga

SEQ ID NO: 209574 - RNA, 1755 nt, Artificial Sequence
  derived and/or modified sequence opt5 from hemagglutinin__InfluenzaB__ACF54279
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauugacgccgaaaaggcuccgggcggccccuaucgccuggggaccagcggauccugcccuaaugccacaagcaaaucuggcuucuuugcgaccauggccugggcugugcccagagagaacaauaagaccgccacaaacccucuuacggucgaagugccccacaucuguaccaaagaggaggaucagauuacaguguggggguuccauuccgacaauaagacccagaugaagaaccuguacggagauagcaauccgcaaaaauuuacaucuuccgcuaacggcaucaccacgcacuaugucagccagauugggggauucccugaccagacagaagauggcggccucccccagucugggcggaucguuguggacuacauggugcaaaagccuggaaaaaccggcaccaucgucuaucagcgcgggauucugcuuccccagaagguguggugcgccuccggaagaagcaaaguuaucaagggcucccugccccucauuggggaggcggauugucugcacgaaaaauacggaggccugaauaagucuaagccuuauuacacaggcgagcaugccaaagcuaucgggaacugcccgauuugggugaagacaccccucaaacuggccaacggaaccaaguaccggccucccgcuaaacuucugaaggagcgcggcuuuuucggggccaucgccggauuucucgaaggcgggugggagggcaugaucgcuggauggcacggcuauacgagccauggggcgcacggagucgccguggcugccgaccugaaguccacccaggaagccauuaauaaaaucacaaagaaccuuaauagccugucugagcucgaaguuaaaaaccugcaaagacuguccggcgcuauggaugagcuccacaaugagauucuggaacuugacgagaagguggacgaucugcgggccgacaccaucagcucucagauugaacucgcgguccugcuuagcaacgaggggaucaucaauuccgaagaugagcaucugcucgcucuggagcgcaaacugaagaagaugcucggaccuucugccguggacauuggcaacggguguuucgaaacaaaacacaagugcaaucagaccugccuggauagaaucgccgcuggcacguuuaacgccggagaguucagccuucccaccuuugacucccugaauauuacagcugccagccucaacgaugacggccuggauaaucauaccauccugcuuuacuauucuacagcggccuccagccucgcugucacccugaugauugccaucuucauuguguacaugaucucucgggacaacguuuccuguagcaucugccuguga

SEQ ID NO: 209575 - RNA, 1755 nt, Artificial Sequence
  derived and/or modified sequence opt5 from hemagglutinin__InfluenzaB__ACF54290
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaauguggucgaugcugaaaacgccccgggcggccccuacagacuggggaccagcggauccugcccuaaugcuacaagcaagucuggcuucuuugccaccauggcgugggccgugcccaaagacaacaauaagaacgcuaccaauccucuuacaguggagguccccuauguuuguacggaaggggaggaucagaucaccguguggggauuccauuccgacaaaaagacacagaugaaaaaccuguacggcgauagcaauccgcaaaaguuuaccucuuccgccaacggggugacaacccacuaugucagccagauuggaggcuucccugcucagacggaggacggcgggcucccccagucuggacggaucgugguugauuacauggugcaaaagccucgcaaaacaggcaccauugucuaucagagaggggugcugcuuccccagaagguuuggugcgccuccggacggagcaaagugaucaagggcucccugccccucauuggggaagcggacugucugcaugagaaauacggaggccugaacaagucuaaaccuuacuauaccggcgaacacgccaaggcuaucgggaauugcccgaucugggucaagacaccccucaaacuggccaacggaaccaaguaccgcccucccgcuaaacuucugaaggagagaggcuuuuucggggccauugccggauuucucgagggcgggugggaaggcaugaucgcuggauggcacggcuauacaagccauggggcgcacggaguggccgucgcugccgaucugaaauccacgcaggaggccauuaauaagaucaccaagaaccuuaauagccugucugaacucgaggugaaaaaccugcaacggcuguccggcgcuauggacgaacuccauaaugagauucuggagcuugacgaaaagguugaugaccugcgcgccgauacaaucagcucucagaucgagcucgcggugcugcuuagcaacgaagggauuaucaauuccgaggacgaacaucugcucgcucuggagagaaaacugaagaaaaugcucggaccuucugccgucgauauuggcaacggguguuucgagaccaagcacaagugcaaucagacaugccuggacaaaaucgccgcuggcaccuuuaacgccggagaguucagccuucccacguuugauucccugaauauuaccgcugccagccucaacgacgauggccuggacaaucacacaauccugcuuuacuauucuaccgcggccuccagccucgcugugacacugaugcuggccaucuucauuguuuacauggugucucgggauaacgucuccuguagcaucugccucuga

SEQ ID NO: 209576 - RNA, 1758 nt, Artificial Sequence
  derived and/or modified sequence opt5 from hemagglutinin__InfluenzaB__ACF54312
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacuccgaaacacagauggccaaacuuuauggggauagcaagccccagaaguuuaccucuuccagcaacggaguuacaacccacuacaucucucaaaucggcggcuucccgaaccagacggaggacgggggacugccucaguccggccgcauugugguggauuauaugguccaaaagagcgggaaaacaggaaccaucaccuaccagagaggcauucuccugccccagaagguguggugcgcuuccgggcggucuaaaguuaucaagggaagccuuccucugauuggcgaagccgacugucuccaugagaaauauggcgggcugaauaaguccaagcccuacuacacaggagagcacgcuaaagccaucggcaacugccccaucugggugaagaccccucugaaacucgcgaaugggacaaaguaucgcccgcccgccaaacugcuuaaggaaagaggauuuuucggcgcuauugccggguuucuggagggcggaugggaaggcaugaucgcuggguggcauggauacacgagccacggcgcccacggggucgccguggcugcggaucucaagucuacccaggaggccauuaacaaaaucacaaagaaucugaacucccuuagcgaacuggagguuaaaaaucuccagcggcugucuggagcuauggacgagcugcauaacgaaauucucgagcuggaugaaaagguggacgaccuucgcgccgauaccaucagcucccaaaucgagcuggccguccuccugucuaaugaaggcauuaucaacagcgaggacgagcaccuucuggcucucgaaagaaaacugaagaagaugcuggggccuuccgccauugagaucggcaauggauguuucgaaacaaaacauaagugcaaccagaccugccucgaucggauugcggcuggcacguuugacgccggggaguucagccugcccaccuuugauucucuuaauaucacagccgcuucccugaacgacgauggacucgacaaucacaccauucugcuguauuacagcacagccgcuucuucccuugccgugacccucaugaucgcgaucuucgucguguauaugguuagccgcgauaacguguccuguucuauuugccuguga

SEQ ID NO: 209577 - RNA, 1758 nt, Artificial Sequence
  derived and/or modified sequence opt5 from hemagglutinin__InfluenzaB__ACF54323
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgagaaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccauucugacaacgaagcccagauggcuaaacuuuauggggauuccaagccccagaaguuuacaagcucugccaauggaguuaccacacacuacgugucccaaaucggcggcuucccgaaccagaccgaggacgggggacugccucagagcggccggaucguggucgauuauauggugcagaagucugggaaaacgggaacaauuaccuaccaacgcggcauccuccugccccagaagguuuggugcgcuuccgggagaagcaaagugauuaagggaucccuuccucugaucggcgaagccgacugucuccacgagaaauauggcgggcugaauaagucuaaacccuacuacaccggagagcaugcgaaggccauuggcaacugccccaucugggucaagacaccucugaaacucgcuaaugggaccaaguaucggccgcccgccaaacugcuuaaggaacgcggauuuuucggcgcuaucgccggguuucuggagggcggaugggaaggcaugauugccggguggcacggauacacaagccauggcgcucacgggguggcgguugccgcugaucucaaauccacgcaggaggccaucaacaagauuaccaagaaucugaacagccuuucugaacuggaggugaaaaaucuccagagacuguccggagccauggacgagcugcacaacgaaauccucgagcuggaugaaaaggucgacgaccuucgggcugauacaauuagcucucaaaucgagcuggccgugcuccugagcaaugaaggcaucauuaacuccgaggacgagcaucuucuggcgcucgaacgcaaacugaagaaaaugcuggggccuucugcugucgagaucggcaauggauguuucgaaaccaagcacaagugcaaccagacaugccucgauagaauugccgccggcaccuuugacgcuggggaguucagccugcccacguuugauucccuuaauaucaccgccgcuagccugaacgacgauggacucgacaaccauacaauucugcuguauuacucuaccgccgcguccagccuugccgugacacucaugaucgcuauuuucguuguguauauggucucucgggauaauguguccuguagcaucugccuguga

SEQ ID NO: 209578 - RNA, 1755 nt, Artificial Sequence
  derived and/or modified sequence opt5 from hemagglutinin__InfluenzaB__ACF54345
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaaggcucagaugaaaaaccuguacggcgauagcaauccccaaaaguuuacaucuuccgccaacgggguuaccacacacuaugugagccagauuggaggcuucccggaccagaccgaggauggcgggcucccucagucuggacggaucguggucgacuacaugauucaaaagcccggcaaaacggggacaaucguguaucagcgcggaguucugcuuccucagaagguguggugcgcguccggcagaagcaaagucaucaaggggucccugccccucauuggagaagccgauugucugcaugagaaauacggcggccugaacaagucuaaacccuacuauaccggggaacacgcuaaggccaucggaaauugcccuauuugggugaagaccccgcucaaacuggcuaacggcacaaaguaccggcccccugccaaacuucugcgcgagagaggguuuuucggagccaucgcuggcuuucucgaagggggcugggaaggaaugauugcgggcuggcacggguauaccagccauggagcccacggcguugcuguggccgccgaccugaaguccacacaggaggcuaucaauaaaaucacgaagaaccuuaauagccugucugaacucgaggucaagaaccugcaacggcuguccggggccauggacgaacuccauaaugagauucuggagcuugaugaaaaaguggacgaucugcgcgcggacaccaucagcucucagauugagcucgcuguccugcuuagcaacgaaggaaucauuaauuccgaggaugaacaucugcucgcccuggagagaaagcugaaaaagaugcucggccccucugccguggacaucgggaacggcuguuucgagacaaaacacaagugcaaucagaccugccuggaucggaucgcugccggaacauuuaacgcuggcgaguucagccuuccuaccuuugacucccugaauauuacggccgcgagccucaacgaugacgggcuggauaaucacaccauccugcuuuacuauucuacagccgcuuccagccucgccguuacccugaugcuggcuauuuucaucguguacauggucucuagagacaacguguccuguagcauuugccucuga

SEQ ID NO: 209579 - RNA, 1755 nt, Artificial Sequence
  derived and/or modified sequence opt5 from hemagglutinin__InfluenzaB__ACF54367
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccgcgccgacaaaguccuacuucgcuaaucuuaaaggcacccggacgcgcgggaagcugugucccgauugccucaacuguaccgaccuggauguggcccuuggaagaccuaugugcgucggcacaacccccucugccaaagcuagcauucugcaugaagugcggccuguuacauccggguguuuucccaucaugcacgaccgcaccaagaucagacaacucgccaaucugcugcggggauaugagaacauucgccucucuacgcagaaugugaucgaugcugaaaaggccccuggcggcccguacagacuggggacaagcggauccugccccaacgcgaccagcaaaucuggcuucuuugccacaauggcuugggccgucccuaaggacaauaacaaaaaugcuaccaacccccuuaccguggaggugccuuauauuuguacagaaggggaggaucagaucacggucuggggauuccauuccgacagcaagacccagaugaaaaaucuguacggcgauucuaacccccaaaaguuuacauccagcgccaaugggguuaccacacacuaugugucucagauuggaggcuucccggaccagaccgaggauggcgggcucccucaguccggacggaucguggucgacuacaugaugcaaaagcccggcaaaacggggacaauuguguaucagcgcggaguucugcuuccucagaagguguggugcgcgagcggcagauccaaagucaucaaggggucucugccccucaucggagaagccgauugucugcaugagaaauacggcggccugaacaagagcaaacccuacuauaccggggaacacgcuaaggccauuggaaacugcccuaucugggugaagaccccgcucaaacuggcuaauggcacaaaguaccggcccccugccaaacuucugaaggagcgcggguuuuucggagccauugcuggcuuucucgaagggggcugggaaggaaugaucgcgggcuggcacggguauaccucccauggagcccacggcguugcuguggccgccgaccugaaaagcacacaggaggcuauuaacaagaucacgaagaaucuuaacucucuguccgaacucgaggucaaaaaucugcaaagacugagcggggccauggacgaacuccauaacgagauccuggagcuugaugaaaagguggacgaucugcgggcggacaccauuucuagccagaucgagcucgcuguccugcuuuccaaugaaggaauuaucaacucugaggaugaacaucugcucgcccuggagcgcaaacugaagaaaaugcucggccccagcgccguggacauugggaauggcuguuucgagacaaagcacaagugcaaccagaccugccuggauagaaucgcugccggaacauuuaaugcuggcgaguucucccuuccuaccuuugacagccugaacaucacggccgcgucucucaaugaugacgggcuggauaaccacaccauucugcuuuacuauuccacagccgcuagcucucucgccguuacccugaugcuggcuaucuucauuguguacauggucucccgggacaaugugagcuguuccaucugccucuga

SEQ ID NO: 209580 - RNA, 1755 nt, Artificial Sequence
  derived and/or modified sequence opt5 from hemagglutinin__InfluenzaB__ACN32556
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacaacaagacccagaugaagaaucuguacggagauagcaacccgcaaaaauuuacaucuuucgcuaauggcaucaccacgcacuaugucucccagauugggggauuuccugaccagacagaggauggcggccucccccagagcgggcggaucguuguggacuacauggugcaaaagccuggaaaaaccggcaccaucgucuaucagcgcgggauucugcuuccccagaagguguggugcgccucuggaagauccaaaguuaucaagggcagccugccccucauuggggaagcggauugucugcacgagaaauacggaggccugaacaaguccaagccuuauuacacaggcgaacaugccaaagcuaucgggaacugcccgauuugggugaagacaccccucaaacuggccaauggaaccaaguaccggccucccgcuaaacuucugaaggagcgcggcuucuuuggggccaucgccggauuccucgagggcgggugggaaggcaugaucgcuggauggcacggcuauacgucucauggggcgcacggagucgccguggcugccgaccuuaagagcacccaggaggccauuaacaaaaucacaaagaaucugaacucccugagcgaacucgagguuaaaaaucugcaaagacugucuggcgcuauggaugaacuccacaacgagauucuggagcuugacgaaaagguggacgaucugcgggccgacaccaucuccagccagauugagcucgcgguccugcuuucuaaugaagggaucaucaacagcgaggaugaacaucugcucgcucuggagcgcaaacugaagaagaugcucggaccuuccgccguggacauuggcaauggguguuuugagacaaaacacaagugcaaccagaccugccuggauagaaucgccgcuggcacguucaaugccggagaauuuucucuucccaccuucgacagccugaacauuacagcugccucccucaaugaugacggccuggauaaccauaccauccugcuuuacuauagcacagcggccucuucccucgcugucacccugaugauugccaucuucauuguguacaugaucagccgggacaauguuucuuguuccaucugccuguga

SEQ ID NO: 209581 - RNA, 1758 nt, Artificial Sequence
  derived and/or modified sequence opt5 from hemagglutinin__InfluenzaB__ACN32567
auggaagccaucauugugcugcucauggucguuaccagcaacgcugacagaaucugcacaggcauuacguccucuaauagcccccacguggugaagaccgccacacagggggaagucaacgugaccggaguuaucccucugacaaccacaccgaccaaaucccauuucgcgaaucuuaagggcacggagacccgggggaaacugugucccaagugccucaacuguacagaucuggacguggcucuuggacgcccuaaaugcaccggcaauauucccucugccagagucagcauccugcacgaagugcggccuguuacauccggguguuuucccaucaugcaugaucgcaccaagauuagacaacucccuaaccugcugcggggauacgagcacauccgccucucuacgcauaaugugauuaacgccgaaaaugcuccgggcggccccuauaagaucgggacaagcggauccugcccuaacgucaccaauggcaacggguucuuugccacaauggcuugggccgugcccaaaaaugacaacaauaagaccgcgaccaacagccugacaauugaggugccuuacaucuguacggagggagaagaucagauuaccgucuggggcuuccacucugacaacgagacacagauggccaaacuuuauggggauuccaagccccagaaauuuaccagcucugcuaauggaguuacaacccacuacgugucccaaaucggcggcuucccgaaccagacggaagacgggggacugccucagagcggcagaaucguggucgauuauauggugcagaagucugggaagacaggaaccauuaccuaccaacggggcauccuccugccccagaaaguuuggugcgccuccgggcgcagcaaggugauuaaaggaucccuuccucugaucggcgaggcugacugucuccaugagaaguauggcgggcugaauaaaucuaagcccuacuacacaggagaacacgccaaagcgauuggcaacugccccaucugggucaagaccccucugaagcucgccaaugggacaaaauauagaccgcccgcuaagcugcuuaaagagcggggauuuuucggcgccaucgcuggguuucuggaaggcggaugggagggcaugauugccggguggcauggauacacgagccacggcgcccacgggguggcuguugcggccgaucucaaguccacccaggaagcuaucaacaaaauuacaaagaaucugaacagccuuucugagcuggaggugaagaaucuccagcgccuguccggagccauggacgaacugcauaacgagauccucgaacuggaugagaaagucgacgaccuuagagccgauaccauuagcucucaaaucgaacuggcugugcuccugagcaaugagggcaucauuaacuccgaggacgaacaccuucuggcccucgagcggaagcugaaaaagaugcuggggccuucugcggucgaaaucggcaauggauguuucgagacaaaacauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauguguccuguagcaucugccuguga

SEQ ID NO: 209582 - RNA, 1758 nt, Artificial Sequence; identical to SEQ ID NO: 209538
  derived and/or modified sequence opt5 from hemagglutinin__InfluenzaB__ACN32578

SEQ ID NO: 209583 - RNA, 1758 nt, Artificial Sequence
  derived and/or modified sequence opt5 from hemagglutinin__InfluenzaB__ACN32589
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugccucaacuguacagaucuggacguggcgcuuggacgcccuaagugcaccggcaauauucccagcgcuagagucuccauccugcacgaggugcggccuguuacaucuggguguuuucccaucaugcaugaucgcaccaagauuagacaacucccuaaccugcugcggggauacgaacacauccgccucagcacgcauaaugugauuaacgccgagaaugccccgggcggccccuauaaaaucgggacauccggaagcugcccuaacgucaccaauggcaacggguucuuugcuacaauggccugggcugugcccaagaaugacaacaauaaaaccgccaccaacucucugacaauugaagugccuuacaucuguacggagggagaggaucagauuaccaucuggggcuuccacuccgacaacgaaacacagauggcgaaacuuuauggggauagcaagccccagaaguuuaccucuuccgccaauggagucacaacccacuacguuagccaaaucggcggcuucccgaaccagacggaggacgggggacugccucagucuggcagaauugugguggauuauaugguccagaaguccgggaaaacaggaaccaucaccuaccaacggggcauucuccugccccagaagguguggugcgcuagcgggcgcuccaaaguuaucaagggaucucuuccucugauuggcgaagccgacugucuccaugagaaauauggcgggcugaauaagagcaaacccuacuacacaggagagcacgcuaaggccaucggcaacugccccaucugggugaagaccccucugaaacucgcgaaugggacaaaguauagaccgcccgccaaacugcuuaaggaacggggauuuuucggcgcuauugccggguuucuggagggcggaugggaaggcaugaucgcuggguggcauggauacacgucccacggcgcccacggggucgccguggcugcggaucucaaaagcacccaggaggccauuaacaagaucacaaagaaucugaacucucuuuccgaacuggagguuaaaaaucuccagcgccugagcggagcuauggacgagcugcauaacgaaauucucgagcuggaugaaaagguggacgaccuuagagccgauaccaucucuagccaaaucgagcuggccguccuccuguccaaugaaggcauuaucaacucugaggacgagcaccuucuggcucucgaacggaaacugaagaaaaugcuggggccuagcgccguggagauuggcaauggauguuucgaaacaaagcauaagugcaaccagaccugccucgaucgcaucgcggcuggcacguuugacgccggggaguucucccugcccaccuuugauagccuuaauauuacagccgcuucucugaacgacgauggacucgacaaccacaccauccugcuguauuacuccacagccgcuagcucucuugccgucacccucaugauugcgaucuucgugguuuauaugguguccagagauaaugucagcuguuccaucugccuguga

SEQ ID NO: 209584 - RNA, 1758 nt, Artificial Sequence
  derived and/or modified sequence opt5 from hemagglutinin__InfluenzaB__ACN32600
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugccucaacuguacagaucuggacguggcgcuuggacgcccuaagugcaccggcaauauucccagcgcuagagucuccauccugcacgaggugcggccuguuacaucuggguguuuucccaucaugcaugaucgcaccaagauuagacaacucccuaaccugcugcggggauacgaacacauccgccucagcacgcauaaugugauuaacgccgagaaugccccgggcggccccuauaaaaucgggacauccggaagcugcccuaacgucaccaauggcaacggguucuuugcuacaauggccugggcugugcccaagaaugacaacaauaaaaccgccaccaacucucugacaauugaagugccuuacaucuguacggagggagaggaucagauuaccgucuggggcuuccacuccgacaacgaaacacagauggcgaaacuuuauggggauagcaagccccagaaguuuaccucuuccgccaauggaguuacaacccacuacgugagccaaaucggcggcuucccgaaccagacggaggacgggggacugccucagucuggcagaaucguggucgauuauauggugcagaaguccgggaaaacaggaaccauuaccuaccaacggggcauccuccugccccagaagguuuggugcgcuagcgggcgcuccaaagugauuaagggaucucuuccucugaucggcgaagccgacugucuccaugagaaauauggcgggcugaauaagagcaaacccuacuacacaggagagcacgcuaaggccauuggcaacugccccaucugggucaagaccccucugaaacucgcgaaugggacaaaguauagaccgcccgcccggcugcuuaaagaacgcggauuuuucggcgcuaucgccggguuucuggagggcggaugggaaggcaugauugcuggguggcauggauacacgucccacggcgcccacgggguggccguugcugcggaucucaagagcacccaggaggccaucaacaaaauuacaaagaaucugaacucucuuuccgaacuggaggugaagaaucuccagagacugagcggagcuauggacgagcugcauaacgaaauccucgagcuggaugaaaaagucgacgaccuucgggccgauaccauuucuagccaaaucgagcuggccgugcuccuguccaaugaaggcaucauuaacucugaggacgagcaccuucuggcucucgaacgcaagcugaaaaagaugcuggggccuagcgccgucgagaucggcaauggauguuucgaaacaaaacauaagugcaaccagaccugccucgauagaauugcggcuggcacguuugacgccggggaguucucccugcccaccuuugauagccuuaauaucacagccgcuucucugaacgacgauggacucgacaaccacaccauucugcuguauuacuccacagccgcuagcucucuugccgugacccucaugaucgcgauuuucguuguguauauggucucccgggauaaugugagcuguuccaucugccuguga

SEQ ID NO: 209585 - RNA, 1758 nt, Artificial Sequence; identical to SEQ ID NO: 209549
  derived and/or modified sequence opt5 from hemagglutinin__InfluenzaB__ACN32611

SEQ ID NO: 209586 - RNA, 1755 nt, Artificial Sequence; identical to SEQ ID NO: 209450
  derived and/or modified sequence opt5 from hemagglutinin__InfluenzaB__ACN32716

SEQ ID NO: 209587 - RNA, 1758 nt, Artificial Sequence; identical to SEQ ID NO: 209538
  derived and/or modified sequence opt5 from hemagglutinin__InfluenzaB__ACN32771

SEQ ID NO: 209588 - RNA, 1758 nt, Artificial Sequence; identical to SEQ ID NO: 209544
  derived and/or modified sequence opt5 from hemagglutinin__InfluenzaB__ACN32782

SEQ ID NO: 209589 - RNA, 1758 nt, Artificial Sequence
  derived and/or modified sequence opt5 from hemagglutinin__InfluenzaB__ACO05957
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaauccagauggccaaacuuuauggggauuccaagccccagaaguuuacaagcucugcuaauggaguuaccacacacuacgugucccaaaucggcggcuucccgaaccagaccgaggacgggggacugccucagagcggcagaauuguggucgauuauauggugcagaagucugggaaaacgggaacaaucaccuaccaacggggcauucuccugccccagaagguuuggugcgccuccgggcgcagcaaagugaucaagggaucccuuccucugauuggcgaagcugacugucuccaugagaaauauggcgggcugaauaagucuaaacccuacuacaccggagagcacgccaaggcgaucggcaacugccccaucugggucaagacaccucugaaacucgccaaugggaccaaguauagaccgcccgcuaaacugcuuaaggaacggggauuuuucggcgccauugcuggguuucuggagggcggaugggaaggcaugaucgccggguggcauggauacacaagccacggcgcccacgggguggcuguugcggccgaucucaaauccacgcaggaggcuauuaacaagaucaccaagaaucugaacagccuuucugaacuggaggugaaaaaucuccagcgccuguccggagccauggacgagcugcauaacgaaauucucgagcuggaugaaaaggucgacgaccuuagagccgauacaaucagcucucaaaucgagcuggcugugcuccugagcaaugaaggcauuaucaacuccgaggacgagcaccuucuggcccucgaacggaaacugaagaaaaugcuggggccuucugcggucgagauuggcaauggauguuucgaaaccaagcauaagugcaaccagacaugccucgaucgcaucgcugccggcaccuuugacgccggggaguucagccugcccacguuugauucccuuaauauuaccgcugccagccugaacgacgauggacucgacaaccacacaauccugcuguauuacucuaccgcugccuccagccuugcggugacacucaugauugccaucuucguuguguauauggucucuagagauaauguguccuguagcaucugccuguga

SEQ ID NO: 209590 - RNA, 1755 nt, Artificial Sequence
  derived and/or modified sequence opt5 from hemagglutinin__InfluenzaB__ACO05968
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaacgggaggaucagaucaccgucuggggguuccauuccgacaauaagacacagaugaaaaaccuguacggagauagcaauccgcaaaaguuuaccucuuccgccaacggcguuacaacccacuaugugagccagauugggucuuucccugaccagacggaggauggaggccucccccaguccggccgcaucguggucgacuacaugaugcaaaagccugggaaaacaggaaccauuguguaucagagaggcguucugcuuccccagaagguguggugcgcuagcgggcgguccaaagucaucaagggaucucugccccucaucggcgaagccgauugucugcaugagaaauacgggggacugaacaagagcaaaccuuacuauaccggcgaacacgcgaaggccauuggcaauugcccgaucugggugaagacaccccucaaacuggcuaacgggaccaaguaccgcccucccgccaaacuucugaaggagagaggauuuuucggcgcuauugccggguuucucgagggaggcugggaagggaugaucgccggcuggcacggauauacaucccauggcgcucacgggguugcgguggccgcugaccugaaaagcacgcaggaggccauuaauaagaucaccaagaaccuuaauucucuguccgaacucgaggucaaaaaccugcaacggcugagcggagccauggacgaacuccauaaugagauccuggagcuugaugaaaagguggacgaucugcgcgcugacacaauuucuagccagaucgagcucgccguccugcuuuccaacgaaggcauuaucaauucugaggaugaacaucugcucgcgcuggagagaaaacugaagaaaaugcucgggccuagcgcuguggagauuggaaacggcuguuucgaaaccaagcacaagugcaaucagacaugccuggaccggaucgccgccgggaccuuuaacgcuggcgaguucucccuucccacguuugauagccugaauaucaccgccgcuucucucaacgacgauggacuggacaaucacacaauucugcuuuacuauuccaccgccgcgagcucucucgccguuacacugaugcuggcuaucuucauuguguacauggucuccagagauaacgugagcuguuccaucugccucuga

SEQ ID NO: 209591 - RNA, 1755 nt, Artificial Sequence
  derived and/or modified sequence opt5 from hemagglutinin__InfluenzaB__ACO05979
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaucuuucccugaccagacggaggauggcggccucccccaguccgggcggaucguggucgacuacaugaugcaaaagccuggaaaaacaggcaccauuguguaucagcgcgggguucugcuuccccagaagguguggugcgcuagcggaagauccaaagucaucaagggcucucugccccucaucggggaagccgauugucugcaugagaaauacggaggccugaacaagagcaaaccuuacuauaccggcgaacacgcgaaggccauugggaauugcccgaucugggugaagacaccccucaaacuggcuaacggaaccaaguaccggccucccgccaaacuucugaaggagcgcggcuuuuucggggcuauugccggauuucucgagggcgggugggaaggcaugaucgccggauggcacggcuauacaucccauggggcucacggaguugcgguggccgcugaccugaaaagcacgcaggaggccauuaauaagaucaccaagaaccuuaauucucuguccgaacucgaggucaaaaaccugcaaagacugagcggcgccauggacgaacuccauaaugagauccuggagcuugaugaaaagguggacgaucugcgggcugacacaauuucuagccagaucgagcucgccguccugcuuuccaacgaagggauuaucaauucugaggaugaacaucugcucgcgcuggagcgcaaacugaagaaaaugcucggaccuagcgcuguggagauuggcaacggguguuucgaaaccaagcacaagugcaaucagacaugccuggacagaaucgccgccggcaccuuuaacgcuggagaguucucccuucccacguuugauagccugaauaucaccgccgcuucucucaacgacgauggccuggacaaucacacaauucugcuuuacuauuccaccgccgcgagcucucucgccguuacacugaugcuggcuaucuucauuguguacauggucucccgggauaacgugagcuguuccaucugccucuga

SEQ ID NO: 209592 - RNA, 1755 nt, Artificial Sequence; identical to SEQ ID NO: 209591
  derived and/or modified sequence opt5 from hemagglutinin__InfluenzaB__ACO05990

SEQ ID NO: 209593 - RNA, 1758 nt, Artificial Sequence
  derived and/or modified sequence opt5 from hemagglutinin__InfluenzaB__ACO06001
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaaaucagauggccaagcuguauggggauuccaaaccccagaaguuuaccagcuucgcuaacggaguuacaacacacuacgugucucaaaucggcggcuuuccgaaucagaccgaggacgggggacugccucaguccggcagaaucguggucgauuauauggugcaaaagagcgggaaaacgggaacaauuaccuaccagcggggcauccuccugccccagaagguuuggugcgccucugggcgcuccaaagugauuaagggaagccuuccucugaucggcgaagcugacugucuccaugagaaauauggcgggcugaacaaguccaaacccuacuacaccggagagcacgccaaggcgauuggcaauugccccaucugggucaagacaccucugaaacucgccaacgggaccaaguauagaccgcccgcuaaacugcuuaaggaacggggauucuuuggcgccaucgcuggguuccuggagggcggaugggaaggcaugauugccggguggcauggauacacaucucacggcgcccacgggguggcuguugcggccgaucucaaaagcacgcaggaggcuaucaauaagauuaccaagaaccuuaauucccuuagcgaacuggaggugaaaaaccuccagcgccugucuggagccauggacgagcugcauaaugaaauccucgagcuggaugaaaaggucgacgaccuuagagccgauacaauuuccagccaaaucgagcuggcugugcuccugucuaacgaaggcaucauuaauagcgaggacgagcaccuucuggcccucgaacggaaacugaagaaaaugcuggggccuuccgcggucgagaucggcaacggauguuuugaaaccaagcauaagugcaaucagacaugccucgaucgcauugcugccggcaccuucgacgccggggaguuuucucugcccacguucgauagccuuaacaucaccgcugccucccugaacgacgauggacucgacaaucacacaauucugcuguauuacagcaccgcugccucuucccuugcggugacacucaugaucgccauuuucguuguguauauggucagcagagauaacgugucuuguuccaucugccuguga

SEQ ID NO: 209594 - RNA, 1755 nt, Artificial Sequence; identical to SEQ ID NO: 209591
  derived and/or modified sequence opt5 from hemagglutinin__InfluenzaB__ACO06012

SEQ ID NO: 209595 - RNA, 1755 nt, Artificial Sequence; identical to SEQ ID NO: 209591
  derived and/or modified sequence opt5 from hemagglutinin__InfluenzaB__ACO06023

SEQ ID NO: 209596 - RNA, 1755 nt, Artificial Sequence
  derived and/or modified sequence opt5 from hemagglutinin__InfluenzaB__ACO06062
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauugacucuuucccugaucagacggaggacggaggccucccccaguccggccggaucguggucgauuacaugaugcaaaagccugggaaaacaggaaccauuguguaucagcgcggcguucugcuuccccagaagguguggugcgcuagcgggagauccaaagucaucaagggaucucugccccucaucggcgaagccgacugucugcaugagaaauacgggggacugaacaagagcaaaccuuacuauaccggcgaacacgcgaaggccauuggcaauugcccgaucugggugaagacaccccucaaacuggcuaacgggaccaaguaccggccucccgccaaacuucugaaggagcgcggauuuuucggcgcuauugccggguuucucgagggaggcugggaagggaugaucgccggcuggcacggauauacaucccauggcgcucacgggguugcgguggccgcugaccugaaaagcacgcaggaggccauuaauaagaucaccaagaaccuuaauucucuguccgaacucgaggucaaaaaccugcaaagacugagcggagccauggaugaacuccauaaugagauccuggagcuugacgaaaagguggaugaccugcgggcugauacaauuucuagccagaucgagcucgccguccugcuuuccaacgaaggcauuaucaauucugaggacgaacaucugcucgcgcuggagcgcaaacugaagaaaaugcucgggccuagcgcuguggagauuggaaacggcuguuucgaaaccaagcacaagugcaaucagacaugccuggauagaaucgccgccgggaccuuuaacgcuggcgaguucucccuucccacguuugacagccugaauaucaccgccgcuucucucaacgaugacggacuggauaaucacacaauucugcuuuacuauuccaccgccgcgagcucucucgccguuacacugaugcuggcuaucuucauuguguacauggucucccgggacaacgugagcuguuccaucugccucuga

SEQ ID NO: 209597 - RNA, 1758 nt, Artificial Sequence
  derived and/or modified sequence opt5 from hemagglutinin__InfluenzaB__ACO94661
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuuacaaccauggccugggcugugcccaagaaugacaacaauaaaaccgccacaaacagccugacgauugaagugccuuacaucuguaccgagggagaggaucagauuacagucuggggcuuccacucugacaacgaaacccagauggcgaaacuuuauggggauuccaagccccagaaguuuacaagcucugccaauggaguuaccacgcacuacgugucccaaaucggcggcuucccgaaccagacagaggacgggggacugccucagagcggcagaaucguggucgauuauauggugcagaagucugggaaaaccggaaccauuacauaccaacggggcauccuccugccccagaagguuuggugcgcuuccgggcgcagcaaagugauuaagggaucccuuccucugaucggcgaagccgacugucuccaugagaaauauggcgggcugaauaagucuaaacccuacuacaccggagagcacgcuaaggccauuggcaacugccccaucugggucaagacaccucugaaacucgcgaaugggacgaaguauagaccgcccgccaaacugcuuaaggaacggggauuuuucggcgcuaucgccggguuucuggagggcggaugggaaggcaugauugcuggguggcauggauacaccagccacggcgcccacgggguggccguugcugcggaucucaaauccacacaggaggccaucaacaagauuaccaagaaucugaacagccuuucugaacuggaggugaaaaaucuccagcgccuguccggagcuauggacgagcugcauaacgaaauccucgagcuggaugaaaaggucgacgaccuuagagccgauacaauuagcucucaaaucgagcuggccgugcuccugagcaaugaaggcaucauuaacuccgaggacgagcaccuucuggcucucgaacggaaacugaagaaaaugcuggggccuucugccgucgagaucggcaauggauguuucgaaaccaagcauaagugcaaccagacgugccucgaucgcauugcggcuggcaccuuugacgccggggaguucagccugcccacauuugauucccuuaauaucaccgccgcuagccugaacgacgauggacucgacaaccacacaauucugcuguauuacucuaccgccgcuuccagccuugccgugacgcucaugaucgcgauuuucguuguguauauggucucuagagauaauguguccuguagcaucugccuguga

SEQ ID NO: 209598 - RNA, 1758 nt, Artificial Sequence; identical to SEQ ID NO: 209538
  derived and/or modified sequence opt5 from hemagglutinin__InfluenzaB__ACR15622

SEQ ID NO: 209599 - RNA, 1758 nt, Artificial Sequence
  derived and/or modified sequence opt5 from hemagglutinin__InfluenzaB__ACR15633
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacuccgaaacacagauggccaagcuguauggggauagcaaaccccagaaguuuaccucuuccgcuaacggaguuacaacccacuacgugagccaaaucggcggcuucccgaaucagacggaggacgggggacugccucagucuggcagaaucguggucgauuauauggugcagaaguccgggaaaacaggaaccauuaccuaccaacggggcauccuccugccccagaagguuuggugcgccagcgggcgcuccaaagugauuaagggaucucuuccucugaucggcgaagcugacugucuccaugagaaauauggcgggcugaacaagagcaaacccuacuacacaggagagcacgccaaggcgauuggcaauugccccaucugggucaagaccccucugaaacucgccaacgggacaaaguauagaccgcccgcuaaacugcuuaaggaacggggauuuuucggcgccaucgcuggguuucuggagggcggaugggaaggcaugauugccggguggcauggauacacgucccacggcgcccacgggguggcuguugcggccgaucucaaaagcacccaggaggcuaucaauaagauuacaaagaaccuuaauucucuuuccgaacuggaggugaaaaaccuccagcgccugagcggagccauggacgagcugcauaaugaaauccucgagcuggaugaaaaggucgacgaccuuagagccgauaccauuucuagccaaaucgagcuggcugugcuccuguccaacgaaggcaucauuaauucugaggacgagcaccuucuggcccucgaacggaaacugaagaaaaugcuggggccuagcgcggucgagaucggcaacggauguuucgaaacaaagcauaagugcaaucagaccugccucgaucgcauugcugccggcacguuugacgccggggaguucucccugcccaccuuugauagccuuaacaucacagcugccucucugaaugacgauggacucgacaaccacaccauucugcuguauuacuccacagcugccagcucucuugcggugacccucaugaucgccauuuucguuguguauauggucuccagagauaacgugagcuguuccaucugccuguga

SEQ ID NO: 209600 - RNA, 1755 nt, Artificial Sequence
  derived and/or modified sequence opt5 from hemagglutinin__InfluenzaB__ACR15644
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaauccagaugaagaaucuguacggcgauagcaacccgcaaaaauuuacaucuuccgccaacggggugaccacacacuaugugagccagauuggaggcuucccugcucagaccgaggacggcgggcucccccagucuggacggaucgucguggauuacaugguucaaaagccucgcaagacgggcacaauuguguaucagagagggguccugcuuccccagaaaguguggugcgccuccggacggagcaagguuaucaaaggcucccugccccucaucggggaagcggacugucugcaugagaaguacggaggccugaauaaaucuaagccuuacuauaccggcgaacacgccaaagcuauugggaacugcccgaucugggugaagacaccccucaagcuggccaauggaaccaaauaccgcccucccgcuaagcugcugaaagagagaggcuuuuucggggccauugccggauuucucgagggcgggugggaaggcaugaucgcuggauggcacggcuauaccagccauggggcgcacggagucgccguggcugccgaucugaaguccacacaggaggccauuaacaaaaucacgaagaaucuuaacagccugucugaacucgaggucaagaaucugcaacggcuguccggcgcuauggacgaacuccauaacgagauccuggagcuugacgaaaaaguggaugaccugcgcgccgauaccauuagcucucagaucgagcucgcgguucugcuuagcaaugaagggauuaucaacuccgaggacgaacaccuucucgcucuggagagaaagcugaaaaagaugcucggaccuucugccguggauauuggcaauggguguuucgagacaaaacacaagugcaaccagaccugccuggaccggaucgccgcuggcacauuuaaugccggagaguucagccuucccaccuuugauucccugaacaucacggcugccagccucaaugacgauggccuggacaaccauaccauucugcuuuacuauucuacagcggccuccagccucgcugucacccugaugcuggccaucuucauuguguacaugguuucuagagauaacguguccuguagcaucugccucuga

SEQ ID NO: 209601 - RNA, 1758 nt, Artificial Sequence
  derived and/or modified sequence opt5 from hemagglutinin__InfluenzaB__ACR15655
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacuccgaaacacagauggccaagcuguauggggauagcaaaccccagaaguuuaccucuuccgcuaacggaguuacaacccacuacgugagccaaaucggcggcuucccgaaucagacggaggacgggggacugccucagucuggcagaaucguggucgauuauauggugcagaaguccgggaaaacaggaaccauuaccuaccaacggggcauccuccugccccagaagguuuggugcgccagcgggcgcuccaaagugauuaagggaucucuuccucugaucggcgaagcugacugucuccaugagaaauauggcgggcugaacaagagcaaacccuacuacacaggagagcacgccaaggcgauuggcaauugccccaucugggucaagaccccucugaaacucgccaacgggacaaaguauagaccgcccgcuaaacugcuuaaggaacggggauuuuucggcgccaucgcuggguuucuggagggcggaugggaaggcaugauugccggguggcauggauacacgucccacggcgcccacgggguggcuguugcggccgaucucaaaagcacccaggaggcuaucaauaagauuacaaagaaccuuaauucucuuuccgaacuggaggugaaaaaccuccagcgccugagcggagccauggacgagcugcauaaugaaauccucgagcuggaugaaaaggucgacgaccuuagagccgauaccauuucuagccaaaucgagcuggcugugcuccuguccaacgaaggcaucauuaauucugaggacgagcaccuucuggcccucgaacggaaacugaagaaaaugcuggggccuagcgcggucgagaucggcaacggauguuucgaaacaaagcauaagugcaaucagaccugccucgaucgcauugcugccggcacguuugacgccggggaguucucccugcccaccuuugauagccuuaacaucacagcugccucucugaaugacgauggacucgacaaccacaccauucugcuguauuacuccacagcugccagcucucuugcggugacccucaugaucgccauuuucguuguguauauggucuccagagauaacaucagcuguuccaucugccuguga

SEQ ID NO: 209602 - RNA, 1758 nt, Artificial Sequence
  derived and/or modified sequence opt5 from hemagglutinin__InfluenzaB__ACR15666
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcauaaccgcaccaagauuagacaacucccuaaucugcugcggggauacgaacacauccgccucucuacgcauaacgugauuaaugccgagaacgcuccgggcggccccuauaaaaucgggacaagcggauccugcccuaaugucaccaacggcaauggguucuuugccacaauggcuugggccgugcccaagaacgauaauaacaaaaccgcgaccaacagccugacaauugaagugccuuacaucuguacggagggagaggaccagauuaccgucuggggcuuccacucugaugacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauguguccuguagcaucugccuguga

SEQ ID NO: 209603 - RNA, 1758 nt, Artificial Sequence
  derived and/or modified sequence opt5 from hemagglutinin__InfluenzaB__ACR15677
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaauauuaccaacggcaauggguucuuugccacaauggcuugggccguccccaaaaacgacaauaacaagaccgcgaccaauagccugacaaucgaggugccuuacauuuguacggaaggagaggaucagaucaccguguggggcuuccacucugacaacgaggcccagauggcuaaacuuuauggggauuccaagccccagaaguuuacaagcucugccaacggagucaccacacacuacguuucccaaaucggcggcuucccgaaucagaccgaagacgggggacugccucagagcggccgcauugugguggauuauaugguccagaaaucugggaagacgggaacaaucaccuaccaaagaggcauucuccugccccagaaaguguggugcgcuuccgggcggagcaagguuaucaaaggaucccuuccucugauuggcgaggccgacugucuccaugaaaaguauggcgggcugaacaagucuaaacccuacuacaccggagagcacgcgaaggccaucggcaauugccccaucugggugaaaacaccucugaagcucgcuaacgggaccaaauaucgcccgcccgccaagcugcuuaaggagagaggauuuuucggcgcuauugccggguuucuggaaggcggaugggagggcaugaucgccggguggcauggauacacaagccacggcgcucacggggucgcgguggccgcugaucucaaauccacgcaggaagccauuaauaagaucaccaaaaaccugaauagccuuucugagcuggaaguuaagaaccuccagcggcuguccggagccauggacgagcugcauaaugagauucucgaacuggaugagaaaguggacgaccuucgcgcugauacaaucagcucucaaaucgaacuggccguccuccugagcaacgagggcauuaucaauuccgaagacgagcaccuucuggcgcucgagagaaagcugaagaaaaugcuggggccuucugcuguggaaauuggcaacggauguuucgagaccaagcauaaaugcaaucagacaugccucgaucggaucgccgccggcaccuuugacgcuggggaguucagccugcccacguuugauucccuuaacauuaccgccgcuagccugaaugacgauggacucgacaaccacacaauccugcuguauuacucuaccgccgcguccagccuugccgucacacucaugauugcuaucuucgugguuuauauggugucucgcgauaacgucuccuguagcaucugccuguga

SEQ ID NO: 209604 - RNA, 1755 nt, Artificial Sequence; identical to SEQ ID NO: 209591
  derived and/or modified sequence opt5 from hemagglutinin__InfluenzaB__ACR15710

SEQ ID NO: 209605 - RNA, 1755 nt, Artificial Sequence
  derived and/or modified sequence opt5 from hemagglutinin__InfluenzaB__ACR15721
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuaucgccuggggaccagcggauccugcccuaacgcuacaagcagaucuggcuucuuugccaccauggcgugggccgucccccgggacgauaauaagaccgcuacaaacccucuuacgguggaggugcccuacgucuguaccgaaggggaggaccagauuacaguuuggggauuccacuccgauaauaaagcccagaugaagaaccuguauggcgacagcaauccgcaaaaauuuaccucuuccgcuaacggggugacaacccauuacgugagccagaucggaggcuucccugaucagacggaggacggcgggcucccccagucuggacgcauugucguggauuauaugguucaaaagccuggcaagacagggaccaucguguaccagagaggaguccugcuuccccagaaaguguggugcgccuccggccggagcaagguuauuaaagggucccugccccucaucggagaagcggacugucugcacgagaaguauggcggccugaacaaaucuaagccuuacuacaccggggaacacgccaaagcuaucggaaauugcccgauuugggugaagacaccccucaagcuggccaacggcaccaaauaucgcccucccgcuaagcugcugaaagagagaggguuuuucggagccaucgccggcuuucucgaagggggcugggaaggaaugauugcuggcuggcauggguacacaagccacggagcgcauggcgucgccguggcugccgaucugaaguccacgcaggaggccaucaauaaaauuaccaagaaccuuaauagccugucugaacucgaggucaagaaccugcaacggcuguccggggcuauggacgaacuccacaaugagauccuggagcuugacgaaaaaguggaugaccugcgcgccgauacaaucagcucucagauugagcucgcgguucugcuuagcaacgaaggaaucauuaauuccgaggacgaacaccuucucgcucuggagagaaagcugaaaaagaugcucggcccuucugccguggauaucgggaacggcuguuucgagaccaaacauaagugcaaucagacaugccuggaccggauugccgcuggaaccuuuaacgccggcgaguucagccuucccacguuugauucccugaauaucaccgcugccagccucaacgacgaugggcuggacaaucacacaauccugcuuuauuacucuaccgcggccuccagccucgcugucacacugaugauugccaucuucauuguguauaugguuucuagagauaacguguccuguagcaucugccuguga

SEQ ID NO: 209606 - RNA, 1758 nt, Artificial Sequence
  derived and/or modified sequence opt5 from hemagglutinin__InfluenzaB__ACR39336
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaagcccagauggcuaaacuuuauggggauuccaagccccagaaguuuacaagcucugccaauggaguuaccacacacuacgugucccaaaucggcggcuucccgaaccagaccgaggacgggggacugccucagagcggcagaaucguggucgauuauauggugcagaagucugggaaaacgggaacaauuaccuaccaacggggcauccuccugccccagaagguuuggugcgcuuccgggcgcagcaaagugauuaagggaucccuuccucugaucggcgaagccgacugucuccaugagaaauauggcgggcugaauaagucuaaacccuacuacaccggagagcacgcgaaggccauuggcaacugccccaucugggucaagacaccucugaaacucgcuaaugggaccaaguauagaccgcccgccaaacugcuuaaggaacggggauuuuucggcgcuaucgccggguuucuggagggcggaugggaaggcaugauugccggguggcauggauacacaagccacggcgcucacgggguggcgguugccgcugaucucaaauccacgcaggaggccaucaacaagauuaccaagaaucugaacagccuuucugaacuggaggugaaaaaucuccagcgccuguccggagccauggacgagcugcauaacgaaauccucgagcuggaugaaaaggucgacgaccuuagagcugauacaauuagcucucaaaucgagcuggccgugcuccugagcaaugaaggcaucauuaacuccgaggacgagcaccuucuggcgcucgaacggaaacugaagaaaaugcuggggccuucugcugucgagaucggcaauggauguuucgaaaccaagcauaagugcaaccagacaugccucgaucgcauugccgccggcaccuuugacgcuggggaguucagccugcccacguuugauucccuuaauaucaccgccgcuagccugaacgacgauggacucgacaaccacacaauucugcuguauuacucuaccgccgcguccagccuugccgugacacucaugaucgcuauuuucguuguguauauggucucuagagauaauguguccuguagcaucugccuguga

SEQ ID NO: 209607 - RNA, 1755 nt, Artificial Sequence
  derived and/or modified sequence opt5 from hemagglutinin__InfluenzaB__AEA51386
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauuauaaaaacgcuaccaauccucuuacaguggaggugcccuacauuuguacggaaggggagggacagaucaccgucuggggcuuccauuccgauaacaagccgcagaugaaaaaucuguauggggacagcaacccucaaaaguuuacaucuuccgccagcggaguuaccacacacuacgugucucagauuggcgauuuccccgaccagaccgaggauggcgggcucccucaguccggacggaucguggucgacuauaugaugcaaaagcccggcaaaacggggacaauuguguaccagcgcggaguucugcuuccccagaagguguggugcgcuagcggcagauccaaagucaucaaggggucucugccucucaucggagaagccgauugucugcaugagaaauacggcggccugaauaagagcaaaccguauuacaccggggaacacgcgaaggccauuggaaacugccccaucugggugauuaccccucagaagcucgcuaacggcacaaccuuuuccccucccgccaaacugcuuaaggagcggggguucuuuggagcuaucgccggcuuccuggaagggggcugggagggaaugauugccggcuggcacggguauacaagccauggagcucacggcguugcgguggccgcugaccucaaaucuacgcaagaggccaucaauaagaucaccaaaaaccuuaauucccugagcgaacuggaggucaagaaccuccagcgccugucuggggccauggacgaacugcauaaugagauucucgagcuggaugaaaagguggacgaucuuagagcugacacaaucagcucccagauugagcuggccguccuccugucuaacgaaggaaucauuaauagcgaggaugaacaccuucuggcgcucgagcggaaacugaagaaaaugcugggccccuccgcuguggacaucgggaacggcuguuuugagaccaagcacaaaugcaaucaaacaugccucgaucgcaucgccgccggaaccuucaacgcuggcgaauuuagccugccgacguucgacucucuuaauauuaccgccgcuucccugaacgaugacgggcucgauaaucauacaauccugcuguacuauagcaccgccgcgucuucccuugccguuacacucaugcuggcuauuuucaucguguacauggucagcagagacaacguguccuguucuauuugccuguga

SEQ ID NO: 209608 - RNA, 1755 nt, Artificial Sequence
  derived and/or modified sequence opt5 from hemagglutinin__InfluenzaB__AEA51387
augaaggccaucauugugcugcucauggucguuaccagcaacgcugacagaaucugcacagaaauuacguccucuaauagcccccugguggugaaaaccgccacacagggcgaagucaacgugaccgggguuaucccucuuacaaccacaccgaccaaguccuacuucgcgaaucugaaaggaacgcggacccgcggcaagcucugucccgauugccugaacuguacagaccuugauguggcucuggggagaccuaugugcgucggaaccacacccucugccaaagccagcauucuccacgaggugcggccuguuaccuccggcuguuuucccaucaugcaugaccgcacgaagaucagacaacugccuaaucugcuccggggguaugaaaacauucgccugucuacacagaaugugaucgaugcugagaaggccccgggaggccccuacagacuuggcaccagcggguccugcccuaacgcuacaagcaaaauuggauucuuugccaccauggcgugggccguccccaaggacaauuauaaaaacgcuaccaauccucugacaguggaagugcccuacaucuguacggagggcgaggaucagauuaccgucuggggguuccacucugacaacaagacacagaugaaaaaucucuauggagauuccaacccgcaaaaguuuaccagcucugccaauggcguuacaacccauuacgugucccagaucggggacuucccugaucagacggaagacggaggccugccccagagcggccggauuguggucgauuauaugaugcaaaagccugggaaaacaggacccaucguguaccagcgcggcguucuucugccccagaagguguggugcgcuucugggagauccaaagucaucaagggaagccucccucugauuggcgaggccgacugucugcacgaaaaauacgggggacucaacaaguccaaauauucucauaccggcgaccacgcgaagacccugggcaacugcccgaucugggugaagacaccccuuaaacuggccaaugggaccaaguaccggccucccgcuaaacuccugaaggagcgcggauuuuucggcgccauugcuggguuucuugagggaggcugggaagggaugaucgccggcuggcacggauauacaagccauggcgcccacgggguugcuguggcggccgaucugaaauccacgcaggaggcuauuaacaagaucaccaagaaucucaacagccugucugaacuggaggucaaaaaucuccaaagacuguccggagccauggacgaacuucauaacgagauccuggagcucgaugaaaagguggacgaucugcgggccgacacaauuagcucucagaucgagcuugcuguccugcucagcaaugaaggcauuaucaacuccgaggaugaacaucugcuggcccucgagcgcaaacugaagaaaaugcuugggccuucugcgguggacauuggaaauggcuguuucgagaccaagcacaagugcaaccagacaugccuggauagaaucgcugccgggaccuuuaaugccggcgaguucagccuccccacguuugacucccugaacaucaccgcugccagccugaaugaugacggacuugacaaccacacaauucuccuguacuauucuaccgcugccuccagccuggcgguuacacucaugcuggccaucuucauuguguacauggucucucgggauaauguguccuguagcaucugccuuuga

SEQ ID NO: 209609 - RNA, 1755 nt, Artificial Sequence
  derived and/or modified sequence opt5 from hemagglutinin__InfluenzaB__AEA51388
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuucuuauaccggcgaacacgcgaaggccaaggggaacugcccgaucugggugaauacaccccucaaacuggcuaacggaaccaaguaccggccucccgccaaacuuuuuaaggagcgcggcuucuuuggggcuauugccggauuccuggagggcgggugggaaggcaugaucgccggauggcacggcuauacaagccauggggcucacggaguugcgguggccgcugaccucaaauccacgcaggaggccauuaauaagaucaccaagaaccugaauagccuuucugaacuggaggucaaaaaccuccaaagacuguccggcgccauggaugaacugcauaaugagauccucgagcuggacgaaaagguggaugaccuucgggcugauacaauuagcucucagaucgagcuggccguccuccugagcaacgaagggauuaucaauuccgaggacgaacaccuucuggcgcucgagcgcaaacugaagaaaaugcugggaccuucugcuguggauaagggcaacggguguuuugagaccaagcacaaaugcaaucagacaugccucgacagaauugccgccggcaccuucaacgcuggagaauuuagccugcccacguucgauucccuuaauaucaccgccgcuagccugaacgacgauggccucgacaaucauacaauccugcuguacuauucuaccgccgcguccagccuugccguuacacucaugcuggcuauuuucaucguguacauggucucucgggacaacguguccuguagcauuugccuguga

SEQ ID NO: 209610 - RNA, 1755 nt, Artificial Sequence
  derived and/or modified sequence opt5 from hemagglutinin__InfluenzaB__AEA51389
augaaggccaucauugugcugcucauggucguuaccagcaacgcugacagaaucugcacaggcauuacguccucuaucagcccccugguggauaaaaccgccacacagggggaggugaaugucaccggagugauuccucuuacaaccacaccgaccaaguccuacuucgcgaacguuaaaggcacgcggacccgcgggaagcugugucccgacugccucaauuguacagaucuggacguggcucuuggaagaccuaugugcgucggcaccacacccucugccaaagccagcauccugcacgaagugcggccuguuaccuccggguguuuucccaucaugcaugaucgcacgaagauuagacaacucccuaaccugcugcggggauaugagaauauccgccucucuacacagaacgugauugacgcucagaaggccccgggcggccccuacagacuggggaccagcggauccugcccuaaugcuacaagcaaaaucggcuucuuugccaccauggcgugugccguccccaaggauaacuauaaaaaugcuaccaacccucuuacaguggaagugcccuacauucggacggagggggaagaccagaucaccgucuggggauuccacucugauaauaagacacaaaugaaaaaccuguauggcgacuccaauccgccuaaguuuaccagcucugccaacgggguuacaacccauuacgugucccagacgggagauuuccccgaccagacagaggauggcggccucccucccagcgggcgcauuguggucgacuauaugaugcagaagcccggaaaaaccggcaccaucgcuuaccaaagaggggugcugcuuccucagaagguuuggugcgccucuggacgguccaaagugaucaagggcagccugccgcucauuggggaggcggacugucugcacgaaaaauacggaggccugaauaaguccaaacccccucauacaggcgagcacaccaaggccaucgggaacugccccauuugggucaagacaccucucaaacuggcuaacggaacgaaguaucgccccucugccaaacuucugaaggaaagaggcuuuuucggggcuaucgccggauuucucgagggcgggugggagggcaugauugccggauggcacggcuacaccagccauggggcucacggaguggcgguugccgcugaucugaaauccacacaggaagccaucaauaagaucaccaagaaccuuaauagccugucugagcucgaagugaaaaaccugcagcggcuguccggcgccauggacgagcuccauaaugaaauucuggagcuugaugagaaggucgacgaucugcgcgcugacacaaucagcucucaaauugaacucgccgugcugcuuagcaacgaggggaucauuaauuccgaagaugagcaucugcucgcgcuggaaagaaaacugaagaaaaugcucggaccgucugcugucgacaucggcaacggguguuucgagaccaagcacaagugcaaucagacgugccuggaucggaucgccgccggcaccuuuaacgcuggagaguucuuucuuccuacauucgacagccugaauauuaccgccgcuucccucaacgaugacggccuggacaaucacacaauccugcuuuauuacagcaccgccgcgucuucccucgccgugacgcugaugcuggcuauuuucaucguuuauauggugagcagagauaacgucucuuguuccauuugccucuga

SEQ ID NO: 209611 - RNA, 1755 nt, Artificial Sequence
  derived and/or modified sequence opt5 from hemagglutinin__InfluenzaB__AEA51390
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccugcccccuagcgggcggauuguggucgauuauaugaugcagaagcccggaaaaacaggcaccaucguguaccaacgcgggggacugcuuccccagaagguuuggugcgcuucuggcagauccaaagugaucaaggggagccugccucucauuggagaagccgacugucugcaugagaaauacggcggccugaacaaguccaaaccguauuacaccggggaacacgcgaaggccaucggaaacugccccauuugggucaagccuccccucaaacuggcuaauggcacaaaguaucggccucccgccaaacuuuuuaaggagcgcggguucuuuggagcucuggccggcuuccucgaagggggcugggagggaaugaucgccggcuggcacggguacaccucucauggagcucacggcguggcgguugccgcugaccugaaaagcacacaggaggccauuaacaagaucacgaagaaucuuaacucccugagcgaacucgaggugaaaaaucugcagagacugucuggggccauggaugaacuccauaacgagauccuggagcuugacgaaaaggucgaugaccugcgggcugauaccauuuccagccaaaucgagcucgccgugcugcuuucuaaugaaggaauuaucaacagcgaggacgaacaccuccucgcgcuggagcgcaaacugaagaaaaugcucggcccguccgcugucgauauugggaauggcuguuuugagacaaagcacaagugcaaccagaccugccuggacagaaucgccgccggaacauucaaugcuggcgaauuuucucuuccuaccuucgauagccugaacaucacggccgcuucccucaaugacgaugggcuggacaaccauaccauucugcuuuauuacagcacagccgcgucuucccucgccgugacccugaugcuggcuaucuucauuguuuauauggugagccgggacaaugucucuuguuccaucugccucuga

SEQ ID NO: 209612 - RNA, 1758 nt, Artificial Sequence
  derived and/or modified sequence opt5 from hemagglutinin__InfluenzaB__AEA51391
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgucaaugaaacacagauggccaaacuuuauggggacucuaagccgcagaaguuuaccuccagcgcuaacggaguuacaacccacuacaucucucaaauuggcggcuucccuaaccagacggaggaugggggacugccccaguccggcagaaucgugguggacuauaugguccaaaagagcgggaaaacaggaaccauuaccuaccagcggggcauccuccugccucagaagguguggugcgccucugggcgcuccaaaguuauuaagggaagccuuccccugaucggcgaagcugauugucuccaugagaaauauggcgggcugaauaaguccaagcccuacuacacaggagagcacgccaaagcgaucggcaacugcccuauuugggugaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguccccguggcugcggaccucaagagcacccaggaggccaucaacaaaauuacaaagaaucugaacucccuuagcgaacuggagguuaaaaaucuccagcgccugucuggagcuauggaugagcugcauaacgaaauccucgagcuggacgaaaagguggaugaccuuagagccgacaccaucuccagccaaauugagcuggccguccuccugucuaaugaaggcaucauuaacagcgaggaugagcaccuucuggcucucgaacggaaacugaagaagaugcuggggccuuccgccguggagaucggcaauggauguuucgaaacaaaacauaagugcaaccagaccugccucgaccgcauugcggcuggcacguuugaugccggggaguucucucugcccaccuuugacagccuuaauaucacagccgcuucccugaacgaugacggacucgauaaucacaccauucugcuguauuacagcacagccgcuucuucccuugccgucacccucaugaucgcgaucuucgugguuuauauggugagcagagacaacgucucuuguuccauuugccuguga

SEQ ID NO: 209613 - RNA, 1758 nt, Artificial Sequence
  derived and/or modified sequence opt5 from hemagglutinin__InfluenzaB__AEA51392
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaggcacaacccacuacguuucucaaaucggcggguuccccaaccagacggaggacggaggccuuccucaguccgggagaaucgugguggauuauaugguccaaaagagcggaaaaacaggcaccauuaccuaccagcgggggauccugcucccccagaagguguggugcgccucuggacgcuccaaaguuauuaagggcagccugccccuuaucggcgaagcugacugucugcaugagaaauaugggggacucaauaaguccaagccuuacuacacaggcgagcacgccaaagcgauugggaacugcccgaucugggugaagacaccccugaaacuggccaauggaaccaagaacaucgcuccugccaaacuccugaaggaaagaggcuuuuucggggcuauugccggcuuucuugagggaggcugggaagggaugaucgccggauggcauggcuauacgucucacggggcucacggagucgcgguggccgcugaucugaaaagcacccaggaggccauuaauaagaucacaaagaaccucaauucccugagcgaacuugagguuaaaaaccugcagcggcucucuggcgccauggacgagcugcauaaugaaauucuggagcucgaugaaaagguggacgaccugcgcgcugauaccaucuccagccaaaucgagcuugccguccugcucucuaacgaagggauuaucaauagcgaggacgagcaucugcuugcgcuggaaagaaaacucaagaagaugcugggccccuccgcuguggagauuggaaacggcuguuucgaaacaaaacacaagugcaaucagaccugccuggaucggaucgccgccgggacguuugacgcuggagaguucucucucccuaccuuugauagccugaacauuacagccgcuucccuuaaugacgauggccuggacaaccacaccauccuccuguacuauagcacagccgcgucuucccuggccgucacccuuaugauugcuaucuucgugguuuacauggugagccgcgauaacgucucuuguuccaucugccucuga

SEQ ID NO: 209614 - RNA, 1755 nt, Artificial Sequence
  derived and/or modified sequence opt5 from hemagglutinin__InfluenzaB__AEA51395
augaaggccaucauugugcugcucauggucguuaccagcaacgcugacagaaucugcacaggcauuacguccucuaauagcccccacguggugaaaaccgccacacugggggaagucaacgugaccggaguuaucccucuuacaaccacaccgaccaaguccuacuucgcgaaucugaaaggcacgcggacccgcgggaagcucugucccgauugccugaacuguacagaccuugauguggcucugggaagaccuaugugcgucggcaccacacccucugccaaagccagcauucuccaugaagugcggccuguuaccuccggguguuuucccaucaugcacgaccgcacgaagaucagacagcugccuaaucugcuccggggauaugagaacauucgccugucuacacaaaaugugaucgaugcugaaaaggccccgggcggccccuacagacuugggaccagcggauccugcccuaacgcuacaagcaaaauuggcuucuuugccaccauggcgugggccguccccaaggacaauuauaaaaacgcuaccaauccucugacaguggaggugcccuacaucuguacggaaggggaggaucaguucaccgucuggggauuucauucugacaacauuacacagcucaagaaucuguucggcgauuccaacccgcagcgguuuaccagcucugccaaugggguuacaacccacuaugugucccaaaucggagacuucccugaucagacggaggacggcggccuuccccagagcgggcgcauuguggucgauuacgugaugcagaaaccuggaaagacaggcaccaucguuuaucaaagaggggugcugcucccucccaaggucugguuugcucggggacgcucuaaagugaucaagggcucccugccccugauuggggaagccgacugcauccaugagaaauacggaggccucaacaagagcaaaccguacuauaccggcgaacacgcgaaggccauugggaacugucccaucuggguuaaaacaccucugaaacuugcuaauggaaccaaguacagacccccugccaagcugcucaaggagcggggcuucuuuggggcuauugccggauuccuggagggcgggugggaaggcaugaucgccggauggcacggcuauacaucccauggggcucacggaguggcggucgccgcugaccuuaaaucuacgcaggaggccaucaacaagauuaccaaaaaucugaacagccucuccgaacuggaggugaagaaucugcagcgccucagcggcgccauggaugaacugcauaacgagauccuugagcuggacgaaaaggucgaugaccucagagcugauacaauuucuucccagaucgagcuggccgugcuucugagcaaugaagggauuaucaacucugaggacgaacaccuccuggcgcuggagcggaaacucaagaaaaugcugggacccagcgcuguugauaucggcaaugggugcuuugagaccaagcacaaauguaaccaaacaugccuugacagaauugccgccggcaccuucaaugcuggagaguucucccugccgacguuugauucucucaacaucaccgccgcuagccugaaugacgauggccuggacaaccauacaauucuucucuacuauuccaccgccgcgagcucucuggccgugacacugaugcucgcuaucuucauugucuacauggugucccgcgacaauguuagcugcucuaucugucuguga

SEQ ID NO: 209615 - RNA, 1758 nt, Artificial Sequence
  derived and/or modified sequence opt5 from hemagglutinin__InfluenzaB__AEA51398
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcauuggguucuuugccacaauggcuugggccgugccuaaaaaugacaagaacaaaaccgcgaccaauccccucacaaucgaagugccguacauuuguacggagggagaggaucagaucaccgucuggggcuuccacagcgacaacgaaacacagauggccaagcuguauggggauucuaagccucagaaauuuaccuccagcgcuaauggaguuacaacccacuacgugucucaaaucggcggcuuccccaaccagacggaggacgggggacuuccucaguccggcagaauuguggucgauuauauggugcaaaagagcgggaaaacaggaaccaucaccuaccagcggggcauucugcucccccagaagguuuggugcgccucugggcgcuccaaagugaucaagggaagccugccccuuauuggcgaagcugacugucugcaugagaaauauggcgggcucaacaaguccaagucuuacuacacaggagagcacgccaaagcgaucggcaauugcccuaucugggucaagaccccgcugaaacuggccaacgggacaaaguauagacccccugcucaucucagcuacuuuuguggauucuuuggcgccauugcuggguuccuggaaggcggaugggagggcaugaucgccggguggaauggauauacgucccacggcgcccacgggguggcuguuguggcggaucuuaaaagcacccaggaagccauuaacaagaucacaaagaaucugaacucucucuccgagcuggaagucaaaaaucuucagcggcugagcggagcuauggacgagcuccauaacgagauucuggaacuggaugagaagguggacgaccuccgcgccgauaccaucucuagccaaaucgaacuggccguccuucuguccaaugagggcauuaucaacucugaagacgagcaccuccuggcucuugagagaaaacugaagaaaaugcucgggcccagcgccguggaaauuggcaauggaugcuuugagacaaagcauaagugcaaccagaccugucuggaucggaucgcggcuggcacguucgacgccggggaauuuucccugccuaccuucgauagccucaauauuacagccgcuucucugaacgacgauggacuugacaaucacaccauccugcucuacuauuccacagccgcuagcucucuggccguuacccugaugauugcgaucuucguggucuacauggugucccgcgauaacguuagcugcuccaucugucuuuga

SEQ ID NO: 209616 - RNA, 1758 nt, Artificial Sequence
  derived and/or modified sequence opt5 from hemagglutinin__InfluenzaB__AEA51399
augaaggccaucauugugcugcucauggucguuaccagcaacgcugacagaaucugcacaggcauuacggccucccagucucccaauaucgauaaaagcuccacccaaggggaggugaacgugacaggagucauuccucugaccacaaccccgacaaagucucacuucgcgaaucuuaaaggcaccgaaacgcgggggaagcugugucccaaaugcccuaacuguaccgaccucgauguggcucugggacgccccaagugcacaggcaagaucccuagcgccagaguuuccauccuucaugaggugcggcccgucaccucuggguguuuuccuauuaugcacgaccgcacaaaaaucagacagcugccgaaucuccugcggggauacgaacauauucgccugagcacccacaacgugaucaaugccgagaacgcucccggcggcccuuauaagauugggacguccggaagcugccccaauguuacaaacggcaucggguucuuugccaccauggcuugggccgugccuaaaaaugauaagaacaaaacagcgaccaauccccucaccauugaagucccguacaucuguacagagggagaggaccagaucacgguguggggcuuccauucugauaacgaaacccagauggccaagcuguauggggacuccaagccucaaaaauuuacaagcucugcuaauggagugaccacacacuacgucucccagauuggcggcuuccccaaccagaccgaggaugggggacuuccucagagcggcagaaucguuguggacuauauggugcaaaagucugggaaaacgggaacaauuaccuaccagcggggcauccugcucccccagaaggucuggugcgccuccgggcgcagcaaagugauuaagggaucccugccccuuaucggcgaagcugauugucugcacgagaaauauggcgggcucaacaagucuaagagcuacuacaccggagagcaugccaaagcgaucggcaauugcccuauuuggguuaagacaccgcugaaacuggccaacgggaccaaguauagacccccugcucaccucuccuacuuuuguggauucuuuggcgccaucgcuggguuccuggaaggcggaugggagggcaugauugccggguggaauggauauacaagccauggcgcccacgggguggcugucguggcggaccuuaaaucuacgcaggaagccaucaacaagauuaccaagaaucugaacucccucagcgagcuggaaguuaaaaaucuucaacggcugucuggagcuauggaugagcuccacaacgagauccuggaacuggacgagaagguggacgaucuccgcgccgacacaaucagcucccagauugaacuggccguccuucugucuaaugagggcaucauuaacagcgaagaugagcaucuccuggcucuugagagaaaacugaagaaaaugcucgggcccuccgccguggaaaucggcaauggaugcuuugagaccaagcacaagugcaaccagacaugucuggaccggauugcggcuggcaccuucgaugccggggaauuuagccugccuacguucgacucucucaauaucaccgccgcuucccugaacgaugacggacuugauaaucauacaauucugcucuacuauagcaccgccgcuucuucccuggccgucacacugaugaucgcgaucuucgugguuuacauggugagccgcgacaacgucuccugcucuauuugucuuuga

SEQ ID NO: 209617 - RNA, 1758 nt, Artificial Sequence
  derived and/or modified sequence opt5 from hemagglutinin__InfluenzaB__AEG21014
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccuccacuguacagaucuggacguggcucuuggacgcccuaagugcaccggcaagauucccucugccagagucagcauccugcaugaggugcggccuguuacauccggguguuuucccaucaugcacgaucgcaccaaaauuagacaacucccuaaccugcugcggggauacgaacauauccgccucucuacgcacaaugugauuaacgccgagaaugcuccgggcggccccuauaagaucgggacaagcggauccugcccuaacgucaccaauggcaacggguucuuugccacaauggcuugggccgugcccaaaaaugacaacaauaagaccgcgaccaacagccugacaauugaagugccuuacaucuguacggagggagaggaucagauuaccgucuggggcuuccacucugacaaugaaacacagauggccaaacuuuauggggauuccaagccccagaaguuuaccagcucugcuaacggaguuacaacccauuacgugucccaaaugggcggcuucccgaaccagacggaggacgggggacugccucagagcggcagaaucguggucgauuauauggugcagaaaucugggaagacaggaaccaucaccuaccaacggggcauucuccugccccagaaaguuuggugcgccuccgggcgcagcaaggugaucaaaggaucccuuccucugauuggcgaagcugacugucuccacgagaaguauggcgggcugaauaaaucuaagcccuacuacacaggagagcaugccaaggcgaucggcaacugccccauuugggucaaaaccccucugaagcucgccaaugggacaaaauauagaccgcccgcuaagcugcuuauggaacggggauuuuucggcgccaucgcuggguuucuggagggcggaugggaaggcaugaucgccggguggcacggauacacgagccacggcgcccaugggguggcuguugcggccgaucucaaauccacccaggaggcuauuaacaagaucacaaagaaucugaacagccuuucugaacuggaggugaaaaaucuccagcgccuguccggagccauggacgagcugcacaacgaaauucucgagcuggaugaaaaggucgacgaccuuagagccgauaccaucagcucucaaauugagcuggcugugcuccugagcaaugaaggcaucaucaacuccgaggacgagcaucuucuggcccucgaacggaaacugaagaaaaugcuggggccuucugcggucgagauuggcaauggauguuucgaaacaaagcacaagugcaaccagaccugccucgaucgcaucgcugccggcacguuugacgccggggaguucagccugcccaccuuugauucccuuaauauuacagcugccagccugaacgacgauggacucgacaaucauaccauccugcuguauuacucuacagcugccuccagccuugcggugacccucaugauugccaucuucguuguguauauggucucuagagauaacguguccuguagcauuugccuguga

SEQ ID NO: 209618 - RNA, 1755 nt, Artificial Sequence
  derived and/or modified sequence opt5 from hemagglutinin__InfluenzaB__AEG21015
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaaauggcuucuuugccaccauggcgugggccguccccaaggacaacuauaaaggggcuaccaauccuaagacaguggaggugcccuacauuuguacggaaggagagggccagaucaccgucuggggguuccauucugauaacaaaccgcagaugaagaaucuuuauggagacuccaacccucaaaaguuuacaagcucugccuccggcguuaccacacacuacgugagccagauuggcgauuuccccgaccagaccgaggaugggggacugccucagucuggccggaucguggucgacuauaugaugcaaaaacccgggaagacgggaacaauuguguaccagcgcggcguucuccugccccagaaaguguggugcgcuuccgggagaagcaaggucaucaaaggaucccuuccucugaucggcgaagccgauugucuccaugagaaguacggcgggcugaauaaaucuaagccguauuacaccggagaacacgcgaaggccauuggcaacugccccaucugggugauuaccccucagaaacuggcuaacgggacaaccuuuagcccucccgccaagcuccugaaagagcggggauucuuuggcgcuaucgccggguuccuugagggcggaugggaaggcaugauugccggguggcacggauauacaucccauggcgcucacgggguugcgguggccgcugaccugaaaagcacgcaagaggccaucaauaagaucaccaagaaccucaauucucuguccgaacuugaggucaagaaccugcagcgccucagcggagccauggacgaacugcauaaugagauucuggagcucgaugaaaaaguggacgaucugagagcugacacaaucucuagccagauugagcuugccguccugcucuccaacgaaggcaucauuaauucugaggaugaacaucugcuugcgcuggagcggaagcucaaaaagaugcuggggcccagcgcuguggacaucggcaacggauguuuugagaccaaacacaagugcaaucaaacaugccuggaucgcaucgccgccggcaccuucaacgcuggggaauuuucccucccgacguucgacagccugaauauuaccgccgcuucucuuaacgaugacggacuggauaaucacacaauccuccuguacuauuccaccgccgcgagcucucuggccguuacacuuaugcucgcuauuuucaucguguacauggucuccagagacaacgugagcuguuccauuugccuguga

SEQ ID NO: 209619 - RNA, 1755 nt, Artificial Sequence
  derived and/or modified sequence opt5 from hemagglutinin__InfluenzaB__AEG21016
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaacgggcuaccaacccuaagacaguggaggugcccuacaucuguacggaaggggaggaucagauuaccgucuggggauuccauucugacaauaaaccgcagaugaagaacccuuauggcgauuccaauccccaaaaguuuacaagcucugccuccgggguuaccacacacuacgugagccagaucggagacuucccugaucagaccgaggacggcggccuuccccagucugggcgcauuguggucgauuauaugaugcaaaaacccggaaagacgggcacaaucguguaccagagagggguucugcucccucagaaaguguggugcgcuuccggacggagcaaggucaucaaaggcucccugccgcuuauuggggaagccgacugucugcaugagaaguacggaggccucaacaaaucuaagcccuauuacaccggcgaacacgcgaaggccaucgggaauugcccuauuugggugaaaacaccccugaagcuggcuaacggaaccaaauaucgcccucccgccaagcuccugaaagagagaggcuuuuucggggcuaucgccggauuucuugagggcgggugggaaggcaugauugccggauggcacggcuacaccagccauggggcucacggaguugcgguggccgcugaccugaaguccacacaggaggccaucaacaagaucacgaaaaaucucaacagccugucugaacuugaggucaagaaucugcaacggcucuccggcgccauggaugaacugcauaacgagauucuggagcucgacgaaaaaguggaugaccugcgcgcugauaccaucagcucucagauugagcuugccguccugcucagcaaugaagggaucauuaacuccgaggacgaacaucugcuugcgcuggagagaaagcucaaaaagaugcugggaccgucugcuguggauaucggcaauggguguuucgagacaaagcacaaaugcaaccagaccugccuggaccggaucgccgccggcacauuuaaugcuggagaguucagccucccuaccuuugauucccugaacauuacggccgcuagccuuaaugacgauggccuggacaaccacaccauccuccuguauuacucuacagccgcguccagccuggccguuacccuuaugcucgcuauuuucaucguguauauggucucuagagacaauguguccuguagcauuugccuguga

SEQ ID NO: 209620 - RNA, 1755 nt, Artificial Sequence
  derived and/or modified sequence opt5 from hemagglutinin__InfluenzaB__AEG21017
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuucuuauaccggcgaacacgcgaaggccaucgggaacugcccgauuugggugaagacaccccucaaacuggcuaauggaaccaaguaccggccucccgccaaacuucugaaggagcgcggcuuuuucggggcuaucgccggauuucucgagggcgggugggaaggcaugauugccggauggcacggcuauacaagccauggggcucacggaguugcgguggccgcugaccugaaauccacgcaggaggccaucaacaagaucaccaagaaucuuaacagccugucugaacucgaggucaaaaaucugcaaagacuguccggcgccauggaugaacuccauaacgagauucuggagcuugacgaaaagguggaugaccugcgggcugauacaaucagcucucagauugagcucgccguccugcuuagcaaugaagggaucauuaacuccgaggacgaacaucugcucgcgcuggagcgcaaacugaagaaaaugcucggaccuucugcuguggauaucggcaauggguguuucgagaccaagcacaagugcaaccagacaugccuggacagaaucgccgccggcaccuuuaaugcuggagaguucagccuucccacguuugauucccugaacauuaccgccgcuagccucaaugacgauggccuggacaaccacacaauccugcuuuacuauucuaccgccgcguccagccucgccguuacacugaugcuggcuauuuucaucguguacauggucucucgggacaauguguccuguagcauuugccucuga

SEQ ID NO: 209621 - RNA, 1755 nt, Artificial Sequence
  derived and/or modified sequence opt5 from hemagglutinin__InfluenzaB__AEG21018
augaaggccaucauugugcugcucauggucguuaccagcaacgcugacagaaucugcacaggcauuacguccucuaucagcccccugguggauaaaaccgccacacagggggaggugaaugucaccggagugauuccucuuacaaccacaccgaccaaguccuacuucgcgaacguuaaaggcacgcggacccgcgggaagcugugucccgacugccucaauuguacagaucuggacguggcucuuggaagaccuaugugcgucggcaccacacccucugccaaagccagcauccugcacgaagugcggccuguuaccuccggguguuuucccaucaugcaugaucgcacgaagauuagacaacucccuaaccugcugcggggauaugagaauauccgccucucuacacagaacgugauugacgcucagaaggccccgggcggccccuacagacuggggaccagcggauccugcccuaaugcuacaagcaaaaucggcuucuuugccaccauggcgugugccguccccaaggauaacuauaaaaaugcuaccaacccucuuacaguggaagugcccuacauucggacggagggggaagaccagaucaccgucuggggauuccacucugauaauaagacacaaaugaaaaaccuguauggcgacuccaauccgccuaaguuuaccagcucugccaacgggguuacaacccauuacgugucccagacgggagauuuccccgaccagacagaggauggcggccucccucccagcgggcgcauuguggucgacuauaugaugcagaagcccggaaaaaccggcccuaucgcuuaccaaagaggggugcugcuuccgcagaagguuuggugcgccucuggacgguccaaagugaucaagggcagccugccccucauuggggaggcggacugucugcacgaaaaauacggaggccugaauaaguccaaauauucucauaccggcgaucacgccaagacacucgggaacugcccuaucugggucaagacaccccugaaacuugcuaacggaaccaaguaccgcccuagcgccaaacugcucaaggagagaggcuuuuucggggcuauugccggauuucuggaaggcgggugggagggcaugaucgccggauggcacggcuauacgucccauggggcucacggaguggcgguugccgcugaccuuaaaagcacccaggaggccauuaauaagaucacaaagaaccucaauucucuguccgaacuggaggugaaaaaccugcagcggcucagcggcgccauggaugaacugcauaaugagauccuugaacuggacgagaaggucgaugaccuccgcgcugauaccauuucuagccaaaucgagcuggccgugcuucuguccaacgaagggauuaucaauucugaggacgaacaccuccuggcgcuggagagaaaacucaagaaaaugcugggacccagcgcugucgauauuggcaacggguguuucgaaacaaagcacaagugcaaucagaccugccuugaccggaucgccgccggcacguuuaacgcuggagaguucucccugccgaccuuugauagccucaauaucacagccgcuucucugaacgacgacggccuggauaaucauaccauucuucucuacuauuccacagccgcgagcucucuggccgugacccugaugcucgcuaucuucauuguuuacaugguguccagagacaacgucagcuguuccaucugccuguga

SEQ ID NO: 209622 - RNA, 1755 nt, Artificial Sequence
  derived and/or modified sequence opt5 from hemagglutinin__InfluenzaB__AEG21019
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagacgggagacuucccugaucagacagaggacggcggccugcccccuagcgggcggaucguggucgauuauaugaugcagaagcccggaaaaaccggcaccauuguguaccaacgcgggguucugcuuccccagaagguguggugcgcuucuggaagauccaaagucaucaagggcagccugccucucaucggggaagccgacugucugcaugagaaauacggaggccugaacaaguccaaaccgucuuauacaggcgaacacgcgaaggccauugggaacugccccaucugggugaagaccccucucaaacuggcuaauggaacaaaguaccggcccagcgccaaacuucugaaggagcgcggcuuuuucggggcuauugccggauuucucgagggcgggugggaaggcaugaucgccggauggcacggcuauacgucccauggggcucacggaguugcgguggccgcugaccugaaaagcacccaggaggccauuaacaagaucacaaagaaucuuaacucucuguccgaacucgaggucaaaaaucugcagagacugagcggcgccauggaugaacuccauaacgagauccuggagcuugacgaaaagguggaugaccugcgggcugauaccauuucuagccaaaucgagcucgccguccugcuuuccaaugaagggauuaucaacucugaggacgaacaccuccucgcgcuggagcgcaaacugaagaaaaugcucggaccuagcgcuguggauauuggcaauggguguuucgagacaaagcacaagugcaaccagaccugccuggacagaaucgccgccggcacguuuaaugcuggagaguucucccuucccaccuuugauagccugaacaucacagccgcuucucucaaugacgauggccuggacaaccauaccauucugcuuuacuauuccacagccgcgagcucucucgccguuacccugaugcuggcuaucuucauuguguacauggucucccgggacaaugugagcuguuccaucugccucuga

SEQ ID NO: 209623 - RNA, 1758 nt, Artificial Sequence
  derived and/or modified sequence opt5 from hemagglutinin__InfluenzaB__AEG21021
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccauccuccaugaucgcaccaaaauuagacaacugccuaaucugcuccggggauacgaacacauccgccugucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucuuagcaucgaagugcccuacauuuguacagagggagaggaucagaucacgguguggggcuuccacucugacaaugaaacccagauggccaagcuguauggggauuccaagccgcagaaauuuacaagcucugcuaacggagucgccacccacuacguuucccaaaucggcggcuucccuaaccagacagaggacgggggacucccccagagcggcagaauugugguggauuauaugguccagaagucugggaaaaccggaacgaucacauaccaacggggcauucugcuuccucagaagguguggugcgcuuccgggcgcagcaaaguuaucaagggaucccugccccucuuuggcgaagccgacugucugcaugagaaauauggcggguucaauaagucuaagcccuacuacaccggagagcacgcgaaagccauuggcaacugcccuaucugggugaagaccccgcugaaacucgcuaaugggacaaaguauagacccccugccaaacuguuuaaggaacggggauucuuuggcgcuaucgccggguuccuugagggcggaugggaaggcaugauugccggguggcauggauacaccagccacggcgcucacggggucgcgguggccgcugaucugaaguccacacaggaggccaucaacaaaauuacgaagaaucucaacagccugucugaacuugagguuaaaaaucugcagcgccucuccggagccauggacgagcugcauaacgaaauccuggagcucgaugaaaagguggacgaccugagagcugauaccauuagcucucaaaucgagcuugccguccugcucagcaaugaaggcaucauuaacuccgaggacgagcaucugcuugcgcuggaacggaaacucaagaagaugcuggggcccucugcuguggagaucggcaauggauguuuugaaacaaaacacaagugcaaccagaccugccuggaucgcauugccgccggcacauucgacgcuggggaguucagccucccuaccuuugauucccugaauaucacggccgcuagccuuaacgacgauggacuggacaaucacaccauucuccuguauuacucuacagccgcguccagccuggccgucacccuuaugaucgcuauuuucgugguuuauauggugucuagagauaacgucuccuguagcaucugccucuga

SEQ ID NO: 209624 - RNA, 1758 nt, Artificial Sequence
  derived and/or modified sequence opt5 from hemagglutinin__InfluenzaB__AEG21022
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcacaacccccucugccagagccagcauucugcacgagguccggccugugacguccggguguuuucccauccuccaugaucgcacaaagaucagacaacugccuaaucugcuccggggauacgaacacauucgccugucuacccauaacguuaucaaugcugagaacgccccgggcggccccuauaaaauugggacaagcggauccugcccuaauaucaccaacggcaauggguucuuugcuaccauggccugggcggugcccaagaacgacaaaaauaagacagccacgaacccucuuagcgucgaagugcccuacauuuguaccgagggagaggaucagaucacaguguggggcuuccacucugacaaugaaacccagauggcuaaacuguauggggauuccaagccgcagaaguuuacaagcucugccaacggagucgcuacccacuacguuucccaaauuggcggcuucccuaaccagacggaggacgggggacucccccagagcggcagaaucgugguggauuauaugguccagaaaucugggaagacaggaaccaucaccuaccaacggggcauucugcuuccucagcgcggguggugcgccuccggaagaagcaaagugaucaagggcucccugccccucuuuggcgaagcggacugucugcaugagaaauaugggggacugaauaagucuaaacccuacuacacaggcgagcacgccaaggcuauugggaacugcccuaucuggguuaagaccccgcucaaacuggccaauggaacaaaguaucggcccccugcuaaacuuuucaaggaacgcggcuuuuucggggccauugccggcuuucuggagggaggcugggaagggaugaucgcuggauggcauggcuacacgagccacggggcgcacggagugcccgucgccgcugaucucaaauccacccaggaggccaucaacaagauuacaaagaaucugaacagccuuucugaacuggaggugaaaaaucuccagagacuguccggcgccauggacgagcugcauaacgaaauccucgagcuggaugaaaagguugacgaccuucgggcugauaccauuagcucucaaaucgagcuggccgugcuccugagcaaugaagggauuaucaacuccgaggacgagcaccuucuggcgcucgaacgcaaacugaagaaaaugcugggcccuucugcugucgagaucggaaauggcuguuucgaaacaaagcauaagugcaaccagaccugccucgauagaauugccgccgggacguuugacgcuggagaguucagccugcccaccuucgauucccuuaauaucacagccgcuagccugaacgacgauggccucgacaaucacaccauucugcuguauuacucuacagccgcguccagccuugccgugacccucaugaucgcuauuuuugucguguauaugguuucucgggauaacguguccuguagcaucugccuguga

SEQ ID NO: 209625 - RNA, 1755 nt, Artificial Sequence
  derived and/or modified sequence opt5 from hemagglutinin__InfluenzaB__AEG21023
augaaggccaucauugugcugcucauggucguuaccagcaacgcugacagaaucugcacaggcauuacguccucuaauagcccccacguggugaaaaccgccacacugggggaagucaacgaaaccggagugaucccucuuacaaccacaccgaccaaguccuacuucgcgaaucugaaaggcacgcggacccgcgggaagcucugucccgauugccugaacuguacagaccuugauguugcucugggaagaccuaugugcgugggcaccacacccucugccaaagccagcauucuccaugagguccggccugugaccuccggguguuuucccaucaugcacgaccgcacgaagaucagacagcugccuaaucugcuccggggauaugaaaacauucgccugucuacacaaaauguuaucgaugcugagaaggccccgggcggccccuacagacuugggaccagcggauccugcccuaacgcuacaagcaaaauuggcuucuuugccaccauggcgugggccgugcccaaggacaauuauaaaaacgcuaccaauccucugacagucgaagugcccuacaucuguacggagggggaggaucagauuaccguguggggauuccauucugacaacaagacacagaugaaaaaucucuauggcgauuccaacccgcagaaguuuaccagcucugccaauggggucccuacacacuacguuucccaaaucggagacuuccccgauccuaccgaagacggcggccugccccagagcgggcggauuggaguggauuauaugaugcagaagcccggcaaaacggggacaaucguguaccagcgcggaguccuucugccucaaaagguguggugcgcuucuggcagauccaaaguuaucaaggggagccucccgcugauuggagaggccgacugucugcaugaaaaauacggcggccucaacaaguccaaacccuauuacaccggggagcacgcgaaggccaucggaaacugcccuauuugggugaagacaccccugaaacuugcuaauggcaccaaguaucggccucccgccaaacugcucaaggagcgcggguuuuucggagcuaucucuggcuuucuggaagggggcugggagggaaugauugccggcuggcacggguacaccagccauggagcccacggcgucgcuguggcggccgaccuuaaauccacacaggaagcuaucaacaagaucacgaagaaucugaacagccucucugagcuggaaguuaaaaaucugcagagacucuccggggccauggaugagcugcauaacgagauucuugaacuggacgagaagguggaugaccuccgggccgauaccaucagcucucagauugaacuggcuguccuucugagcaaugagggaaucauuaacuccgaagacgagcaccuccuggcccuggagcgcaaacucaagaaaaugcugggcccgucugcgguggaaaucgggaauggcuguuucgagacaaagcacaagugcaaccaaaccugcagcgauagaaucgcugccggaacauuugacgccggcgaguucucccuuccuaccuuugauagccugaauauuacggcugccucucucaacgacgaugggcuggacaaucauaccauccugcuuuauuacuccacagcugccagcucucucgcggucacccugaugauugccaucuucgugguuuauauggugucccgggacaacgucagcuguuccauuugccuguga

SEQ ID NO: 209626 - RNA, 1758 nt, Artificial Sequence
  derived and/or modified sequence opt5 from hemagglutinin__InfluenzaB__AEG21024
augaaggccaucauugugcugcucauggucguuaccagcaacgcugacagaaucugcacaggcauuacguccucuagcagcccccacguggugaaaaccgccacacagggggaggucaaugugaccggaguuaucccucugacaaccacaccgaccaagucuuacuucgcgaaccuuaaaggcacggaaacccgggggaagcugugucccgauugcccuaauuguacagaccucgauguggcucugggacgccccaacugcuggggcaauauuccuagcgccagagucuccauccuucaugaggugcggcccguuaccucuggguguuuuccuaucaugcacgaccgcacaaaaauuagacaacugccgaaccuccugcggggauaugaacauauccgccugagcacccacaaugugauuaacgccgagaaugcucccggcggcccuuacaagaucgggacguccggaagcugccccaacgucacaaauggcaacggguucuuugccaccauggcuugggccgugccuaaggaugacaaaaauaacgcggccacacaucuccugaccauugaagugcccuucuuuuguaccggaggcgagcaccacaucgcugucuggggguucccgucugauaaugacacacuuauggccaagcuguuuggagauuccaacccucagauguucuccucuuccgcuaacggcacgaccacacauuauguuagccagauuggcggguuucccaaucagaccgaggacggaggccucccucaaucugggagaaucgugguggauuacaugguccagaaauccggaaagacaggcaccaucgccuaucagcgcggggugcugcuuccccagaaaguuuggugcgcgagcggacgguccaaggugauuaagggcucucugccccucaucggcgaagccgacugucugcacgagaaauacgggggacugaacaagagcaaaccuuauuacacgggcgaacaugcuaaggccauugggaauugcccgaucugggucaaaacaccccucaagcuggcuaacggaaccaaauacagaccucccgccaagcugcuuaaggagcggggcuucuuuggggccauugcuggcuuccucgagggaggcugggaagggaugaucgcgggauggcacggcuauaccucccacggggcccauggaguggcuguugccgccgaucugaaaagcacacaagaggcuaucaauaagauuaccaaaaaccuuaauucucuguccgaacucgaggugaagaaccugcagcgccugagcggcgccauggacgaacuccacaaugagauccuggagcuugacgaaaaagucgaugaccugagagcggauacaauuucuagccagaucgagcucgcugugcugcuuuccaacgaagggauuaucaauucugaggacgaacaucugcucgcccuggagcggaagcugaagaaaaugcucggcccuagcgccgucgagaucggaaacggcuguuuugaaacgaagcacaaaugcaaucagaccugccuggaucgcauugcugccgggacauucgacgcuggagaguucucccuucccaccuuugauagccugaacaucacagccgcgucucucaaugacgauggccuggacaaccauaccauucugcuuuacuauuccacggccgcuagcucucucgccgugacccugaugaucgcuauuuucguuguguacauggucuccagagauaacgugagcuguuccaucugccuguga

SEQ ID NO: 209627 - RNA, 1755 nt, Artificial Sequence
  derived and/or modified sequence opt5 from hemagglutinin__InfluenzaB__AEG21025
augaaggccaucauugugcugcucauggucguuaccagcaacgcugacagaaucugcacaggcauuacguccucuaauagcccccacguggugaaaaccgccacacugggggaagucaacgaaaccggagugaucccucuuacaaccacaccgaccaaguccuacuucgcgaaucugaaaggcacgcggacccgcgggaagcucugucccgauugccugaacuguacagaccuugauguugcucugggaagaccuaugugcgugggcaccacacccucugccaaagccagcauucuccaugagguccggccugugaccuccggguguuuucccaucaugcacgaccgcacgaagaucagacagcugccuaaucugcuccggggauaugaaaacauucgccugucuacacaaaauguuaucgaugcugagaaggccccgggcggccccuacagacuugggaccagcggauccugcccuaacgcuacaagcaaaauuggcuucuuugccaccauggcgugggccgugcccaaggacaauuauaaaaacgcuaccaauccucugacagucgaagugcccuacaucuguacggagggggaggaucagauuaccguguggggauuccauucugacaucaagacacagaugaaaaaccucuauggcgauuccaauccgcagaaguuuaccagcucugccaacggggucccuacacacuacguuucccaaauuggagacuuccccgauccuaccgaagacggcggccugccccagagcgggcggaucggaguggauuauaugaugcagaagcccggcaaaacggggacaaucguguaccagcgcggaguccuucugccucaaaagguguggugcgcuucuggcagauccaaaguuauuaaggggagccucccgcugaucggagaggccgacugucugcaugaaaaauacggcggccucaauaaguccaaacccuauuacaccggggagcacgcgaaggccauuggaaacugcccuaucugggugaagacaccccugaaacuugcuaacggcaccaaguaucggccucccgccaaacugcucaaggagcgcggguuuuucggagcuauuucuggcuuucuggaagggggcugggagggaaugaucgccggcuggcacggguacaccagccauggagcccacggcgucgcuguggcggccgaccuuaaauccacacaggaagcuaucaauaagauuacgaagaaccugaauagccucucugagcuggaaguuaaaaaccugcagagacucuccggggccauggaugagcugcauaaugagauccuugaacuggacgagaagguggaugaccuccgggccgauaccauuagcucucagaucgaacuggcuguccuucugagcaacgagggaauuaucaauuccgaagacgagcaccuccuggcccuggagcgcaaacucaagaaaaugcugggcccgucugcgguggaaaucgggaacggcuguuucgagacaaagcacaagugcaaucaaaccugcagcgauagaauugcugccggaacauuugacgccggcgaguucucccuuccuaccuuugauagccugaacaucacggcugccucucucaaugacgaugggcuggacaaccauaccauucugcuuuauuacuccacagcugccagcucucucgcggucacccugaugaucgccauuuucgugguuuauauggugucccgggacaaugucagcuguuccaucugccuguga

SEQ ID NO: 209628 - RNA, 1758 nt, Artificial Sequence
  derived and/or modified sequence opt5 from hemagglutinin__InfluenzaB__AEG21026
augaaggccaugauggugcugcucauggucguuaccagcaacgcugacagaaucugcacaggcauuacguccucuaauagcccccacguggugaaaaccgccacacagggggaggucaacgugaccggaguuaucccucugacaauuaccccgacaaagucccauuucgcgaaucuuaaagugaaggaaacccggggcaaacugugucccaagugcccuaacuguacggaucucgacgucgcucuggggcgccccaagugcaccggaaaaaucccuucugccagagugagcauucuucacgaggauacacccguuaccuccggcuguaucccuaucaugcaugaccggacaaagauucgccaacugccgaaucuccugagaggguacgaacacauccggcugucuacccauaacgugauuaaugccgagagcgcucccggaggcccuuauaaaaucggcacguccgggagcugccccaacgucacaaauggaauuggcuuuuucgccaccauggcuugggccgugccuaagaacgauaaaaauaagacagcgaccaacccccucaccaucgaagugccguacauuuguacagagggggaggaccagaucacggucuggggauuucacuucgauaaugaaacccagauggccaagcuguauggcgacucuaaaccucagguuuuuacauccagcgcuaacggggugaaugccgauuucgugucucaaauccgcggauuucccaaccagaccgaggacggcggccuuccucaguccgggagaauugucguggauuacaugguucaaaagagcggaaaaacaggcaccaucacguaucagcgggggauucugcucccccagaagguguggugcgcuucuggacgcuccaaagucaucaaggaaagccugccccuuauuggcgaggccuacuuccagcaggaggaauaugggggacugaacaaauccaagucuuacuacacagaggaacacgcgaaggccaucggcaucuguccuauuugggugaaaaccccgcucaagcuggcuaauaaaaccaaguauagacccccugcccaucugagcuacuuuugcggcuucuuuggggcuaucgccggauuccucgagggcgggugggaaggaaugauugccggcuggaacggguauacaucccacggcgcucauggaguugcgguggucgccgaccugaaaagcacccaagaggcuaucaauaagauuacaaagaaccuuaauucucuguccgagcucgaaguggagacgcugcagcggcuuagcggcgccauggaugaacugcacaacgagauccucgaacuggacgagaaagucgacgaucaccgcgccgacaccaucucuagccagauugagcugcccgaucaacucuccaaugacgggucuaucaacagcgaagaugagcaucugcuugcucuggaaagaaagcucaaaaagaugcugggaccuuccaauggcgacaaagggagcggaggcauugagacaaagcacaaguguaaccagaccugccuugaucggaucgccgcggggacauuugacgcuggcggauucucucaucccaccuucgauuccaaaaaugugacggccgccagccugaacgacgauggccucgacucugggaccauucugcuguacuauuccacagacguuagcaaucucgcugugaccgucaugaugggaaucuuugugaaguacaugguuucccgcgauaacgugucuugcagcauuugucuguga

SEQ ID NO: 209629 - RNA, 1758 nt, Artificial Sequence
  derived and/or modified sequence opt5 from hemagglutinin__InfluenzaB__AEG21027
augaaggccaucauugugcugcucauggucguuaccagcaacgcugacagaaucugcacaggcauuacguccucuaauagcccccacguggugaaaaccgccacacagggggaagucaacgugaccggaguuaucccucugacaauuaccccgacaaagucccauuucgcgaaucuuaaaggcaccgaaacgcgggggaagcugugucccaaaugcccuaacuguaccgaucucgacguggcucugggacgccccaagugcacaggcaagaucccuucugccagagucagcauccuucacgaggugcggcccguuaccuccggguguuuuccuauuaugcaugaucgcacaaaaaucagacaacugccgaaucuccugcggggauacgaacacauucgccugucuacccauaacgugaucaaugccgagaacgcucccggcggcccuuauaagauugggacgagcggauccugccccaaugucacaaacggcaucggguucuuugccaccauggcuugggccgugccuaaaaaugacaagaacaaaacagcgaccaauccccucaccauugaagugccguacaucuguacagagggagaggaucagaucacggucuggggcuuccacuuugacaacgaaacccagauggccaagcuguauggggauagcaagccucagaaauucacaucuuccgcuaauggaguuaacgccgacuuugugagccaaauuggcggcuuccccaaccagaccgaggaugggggacuuccucagucuggcagaaucguggucgacuacauggugcagaaguccgggaaaacaggaaccauuacguaucaacggggcauccugcucccccagaagguuuggugcgcuagcgggcgcucuaaagugauuaaggaaucccugccccuuaucggagaggccuacuuucagcaggaggaauauggcggccugaauaaaagcaaguccuacuacacaggggagcacgcgaaggccaucggaaacuguccuauuugggucaaaaccccgcucaagcuggcuaauggcaccaaauauagacccccugcccaucugucuuacuucugcggguuuuucggagcuaucgccggcuuucucgaagggggcugggagggaaugauugccggcuggaacggguauacaagccacggagcucauggcguggcgguuguggccgaucugaaguccacccaagaagcuaucaauaaaauuacaaagaaccuuaauagccugucugagcucgaggucgaaacgcugcagcggcuuuccggggccauggacgagcugcacaacgaaauccucgagaucgaugaaaagguggacgaccaccgcgccgauaccauuagcucucagaucgagcuggcuguccugcucagcaaugagggaauuaucaacuccgaagacgagcaucugcuugcccuggaaagaaaacucaagaaaaugcugggccccucuaauggggauaagggcagcggaggcauugagacaaaacacaaguguaaccaaaccugccuugaccggaucgcggcugggacauucgaugccggagaguucucccugccuaccuuugacagccucaauauuacggccgcuucucugaacgaugacggccuggauuccgggaccauccuccuguacuauagcacagacgugucuaaucuugccguuaccgugaugaugggaaucuucgucaaguacauggugucccgcgauaacguuagcugcuccauuugucuguga

SEQ ID NO: 209630 - RNA, 1758 nt, Artificial Sequence
  derived and/or modified sequence opt5 from hemagglutinin__InfluenzaB__AEG21028
augaaggccaucauugugcugcucauggucguuaccagcaacgcugacagaaucugcacaggcauuacggccucccagucucccaauaucgauaaaagcuccacccaaggggaggugaacgugucuugugucauuccucugacaaccacaccgaccaagagccacuucgcgaaucuuaaagugaaggaaacacggggaaaacugugccccaaguguccuaacugcaccgaccucgauguuucccugggccgccccaaguguacggggaaaaucccuucugcuagagugagcauccuucaugagguccggcccguggccuccggaggcuuuccuauuaugcacgaccgcaccaagaucagacagcugccgaaucuccugcggggguacgaacauauucgccugagcacacacaacguuaucaaugccgagaacgcucccggaggcccuuauaaaauuggcaccucuggguccugccccaaugugacaaacggaaucggcuucuuugccaccauggcuugggccgucccuaagaaugauaaaaacaagacggcgacaaauccccucaccauugaagugccguacaucuguacagagggggaggaccagaucaccguguggggauuccauagcgauaacgaaacccagauggccaagcuguauggcgacucuaaaccucaaaaguuuacauccagcgcuaauggggucacgacccacuacgccgcuaaaagacccugcuucccuaaccagacagaggauggaggccuuccccagucuggccggauuguuguggacuauauggugcagaaguccgggaaaaccggaacaaucaccuaccaacgcggcauucugcucccccagaaggucuggugugccagcgggagauccaaagugaucaagggaucucugccucuuauuggcgaagcggauugccugcacgagaaguaugggggacucaacaaaagcaaguccuacuacacgggcgagcaugccaaagcuaucggcaauuguccgaucuggguuaagacaccccugaaacuggccagccggaccaugucuaagaccccugcucaccucuccuauuuuugcggguucuuuggagccauugccggcuuccuggaagggggaugggagggcaugaucgcuggguggaacggcuacacaagccauggagcgcacggcguggccgucguggcugaccuuaagucuacccaggaagccauuaauaaaaucacaaagaaccugaauagccucuccgagcuggaaguuaaaaaccuucagcgccugucuggggccauggaugagcuccacaaugagauucuggaacuggacgagaagguggacgaucucagagcugacacgaucagcucccaaaucgaacuggccguccuucugagcaacgagggaauuaucaauucugaagaugagcaucuccuggcgcuugagcggaaacugaagaagaugcucggccccuccgcuguggaaauugggaacggaugcuuugagaccaaacacaaguguaaucagacaugccuggaccgcaucgccgccggcaccuucgaugcuggggaauuuagccugccuacauucgacucucucaacauuaccgccgcuucccugaaugaugacggccuugauaaccauacgauccugcucuauuacagcaccgccgcguccucucuggccgucacacugaugauugcuaucuucgugguuuauauggugagcagagacaaugucuccuguucuaucugccuuuga

SEQ ID NO: 209631 - RNA, 1758 nt, Artificial Sequence
  derived and/or modified sequence opt5 from hemagglutinin__InfluenzaB__AEG21029
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcauuggguucuuugccacaauggcuugggccgugccuaaaaaugacaagaacaaaaccgcgaccaauccccucacaaucgaagugccguacauuuguacggagggagaggaucagaucaccgucuggggcuuccacagcgacucugaaacacagauggccaagcuguauggggauuccaagccucagaaauuuaccagcucugcuaacggaguuacaacccacuacgugucccaaaucggcggcuuccccaaucagacggaggacgggggacuuccucagagcggcagaauuguggucgauuauauggugcagaagucugggaaaacaggaaccaucaccuaccaacggggcauucugcucccccagaagguuuggugcgccuccgggcgcagcaaagugaucaagggaucccugccccuuauuggcgaagcugacugucugcaugagaaauauggcgggcucaacaagucuaagccuuacuacacaggagagcacgccaaagcgaucggcaacugcccgaucugggucaagacaccccugaaacuggccaaugggaccaaguauagaccucccgcuaaacuccugaaggaacggggauuuuucggcgccauugcuggguuucuugagggcggaugggaaggcaugaucgccggguggcauggauacacgagccacggcgcccacgggguggcuguugcggccgaucugaaguccacccaggaggcuauuaacaaaaucacaaagaaucucaacagccugucugaacuugaggugaaaaaucugcagcgccucuccggagccauggacgagcugcauaacgaaauucuggagcucgaugaaaaggucgacgaccugagagccgauaccaucagcucucaaaucgagcuugcugugcugcucagcaaugaaggcauuaucaacuccgaggacgagcaucugcuugcccuggaacggaaacucaagaagaugcuggggccuucugcggucgagauuggcaauggauguuucgaaacaaaacacaagugcaaccagaccugccuggaucgcaucgcugccggcacguuugacgccggggaguucagccuccccaccuuugauucccugaauauuacagcugccagccuuaacgacgauggacuggacaaucacaccauccuccuguauuacucuacagcugccuccagccuggcggugacccuuaugauugccaucuucguuguguauauggucucuagagauaacguguccuguagcaucugccucuga

SEQ ID NO: 209632 - RNA, 1758 nt, Artificial Sequence
  derived and/or modified sequence opt5 from hemagglutinin__InfluenzaB__AEO80052
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccuggaucgcauugcugccggcacguuugacgccggggaguucucucuccccaccuuugauagccugaauaucacagcugccucccuuaacgacgauggacuggacaaucacaccauucuccuguauuacagcacagcugccucuucccuggcggugacccuuaugaucgccauuuucguuguguauauggucagcagagauaacgugucuuguuccaucugccucuga

SEQ ID NO: 209633 - RNA, 1758 nt, Artificial Sequence; identical to SEQ ID NO: 209538
  derived and/or modified sequence opt5 from hemagglutinin__InfluenzaB__AEO80067

SEQ ID NO: 209634 - RNA, 1755 nt, Artificial Sequence
  derived and/or modified sequence opt5 from hemagglutinin__InfluenzaB__AEO80078
augaaggagaucauugugcugcucauggucguuaccagcaacgccgacagaaucugcacaggcauuacguccucuaauagcccccacguggugaaaaccgcuacacagggggaagucaacgugaccggaguuaucccucugacaaccacaccgaccaaguccuacuucgccaaucuuaaaggcacgcggacccgcgggaagcugugucccgauugccucaacuguacagaccuggauguggcgcuuggaagaccuaugugcgucggcaccacacccucugcuaaagccagcauucugcaugaggugcggccuguuaccuccggguguuuucccaucaugcacgaccgcacgaagaucagacaacucgccaaucugcugcggggauaugaaaacauucgccucucuacacagaaugugaucgaugcugagaaggccccuggcggcccguacagacuggggaccagcggauccugccccaacgcuacaagcaaaucuggcuucuuugccaccauggcgugggccgucccuaaggacaauaacaaaaaugcuaccaacccccuuacaguggaagugccuuauauuuguacggagggggaggaucagaucaccgucuggggauuccauuccgacaauaagacacagaugaaaaaccuguacggcgauagcaauccccaaaaguuuaccucuuccgccaacgggguuacaacccacuaugugagccagauuggaggcuucccggaccagacggaagauggcgggcucccucagucuggacggaucguggucgacuacaugaugcaaaagcccggcaaaacagggaccauuguguaucagcgcggaguucugcuuccucagaagguguggugcgcuuccggcagaagcaaagucaucaaggggucccugccccucaucggagaggccgauugucugcaugaaaaauacggcggccugaacaagucuaaacccuacuauaccggggagcacgcgaaggccauuggaaauugcccuaucugggugaagacaccgcucaaacuggcuaacggcaccaaguaccggcccccugccaaacuucugaaggagcgcggguuuuucggagcuauugccggcuuucucgaagggggcugggagggaaugaucgccggcuggcacggguauacaagccauggagcucacggcguugcgguggccgcugaccugaaauccacgcaggaagccauuaauaagaucaccaagaaccuuaauagccugucugagcucgaagucaaaaaccugcaaagacuguccggggccauggacgagcuccauaaugagauccuggaacuugaugagaagguggacgaucugcgggcugacacaauuagcucucagaucgaacucgccguccugcuuagcaacgagggaauuaucaauuccgaagaugagcaucugcucgcgcuggagcgcaaacugaagaaaaugcucggccccucugcuguggacauugggaacggcuguuucgaaaccaagcacaagugcaaucagacaugccuggauagaaucgccgccggaaccuuuaacgcuggcgaguucagccuuccuacguuugacucccugaauaucaccgccgcuagccucaacgaugacgggcuggauaaucacacaauucugcuuuacuauucuaccgccgcguccagccucgccguuacacugaugcuggcuaucuucauuguguacauggucucucgggacaacguguccuguagcaucugccucuga

SEQ ID NO: 209635 - RNA, 1758 nt, Artificial Sequence
  derived and/or modified sequence opt5 from hemagglutinin__InfluenzaB__AEO80086
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccaucuggggcuuccacucugacaacgagacacagauggccaaacuuuauggggauuccaaaccccagaaguuuaccagcucugcuaacggagucacaacccacuacguuucccaaaucggcggcuucccgaaucagacggaagacgggggacugccucagagcggccgcauugugguggauuauaugguccagaaaucugggaagacaggaaccaucaccuaccaaagaggcauucuccugccccagaaaguguggugcgccuccgggcggagcaagguuaucaaaggaucccuuccucugauuggcgaggcugacugucuccaugaaaaguauggcgggcugaacaagucuaaacccuacuacacaggagagcacgccaaggcgaucggcaauugccccaucugggugaaaaccccucugaagcucgccaacgggacaaaauaucgcccgcccgcuaagcugcuuaaggagagaggauuuuucggcgccauugcuggguuucuggaaggcggaugggagggcaugaucgccggguggcauggauacacgagccacggcgcccacggggucgcuguggcggccgaucucaaauccacccaggaagcuauuaauaagaucacaaagaaccugaauagccuuucugagcuggaaguuaagaaccuccagcggcuguccggagccauggacgagcugcauaaugagauucucgaacuggaugagaaaguggacgaccuucgcgccgauaccaucagcucucaaaucgaacuggcuguccuccugagcaacgagggcauuaucaauuccgaagacgagcaccuucuggcccucgagagaaagcugaagaaaaugcuggggccuucugcgguggaaauuggcaacggauguuucgagacaaagcauaaaugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauugccaucuucgugguuuauauggugucucgcgauaacgucuccuguagcaucugccuguga

SEQ ID NO: 209636 - RNA, 1755 nt, Artificial Sequence
  derived and/or modified sequence opt5 from hemagglutinin__InfluenzaB__AEO80097
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcggacccgcgggaagcugugucccgauugccucaacuguacagaccuggauguggcucuuggaagaccuaugugcgucggcaccacacccucugccaaagccagcauucugcacgaagugcggccuguuaccuccggguguuuucccaucaugcaugaccgcacgaagaucagacaacucgcuaaucugcugcggggauacgagaacauucgccucucuacacagaaugugaucgaugccgaaaaggcuccuggcggcccguauagacuggggaccagcggauccugccccaacgccacaagcaaaucuggcuucuuugcgaccauggccugggcugucccuaaggacaauaacaaaaaugccaccaacccccuuacaguggaggugccuuacauuuguacggaaggggaggaucagaucaccgucuggggauuccacuccgacaauaagacacagaugaaaaaccuguauggcgauagcaauccccaaaaguuuaccucuuccgcuaacgggguuacaacccauuacgugagccagauuggaggcuucccggaccagacggaggauggcgggcucccucagucuggacggaucguggucgacuauaugaugcaaaagcccggcaaaacagggaccauuguguaccagcgcggaguucugcuuccucagaagguguggugcgccuccggcagaagcaaagucaucaaggggucccugccccucaucggagaagcggauugucugcacgagaaauauggcggccugaacaagucuaaacccuacuacaccggggaacacgccaaggcuauuggaaauugcccuaucugggugaagacaccgcucaaacuggccaacggcaccaaguaucggcccccugcuaaacuucugaaggagcgcggguuuuucggagccauugccggcuuucucgaagggggcugggaaggaaugaucgcuggcuggcauggguacacaagccacggagcgcauggcguugccguggcugccgaccugaaauccacgcaggaggccauuaauaagaucaccaagaaccuuaauagccugucugaacucgaggucaaaaaccugcaaagacuguccggggcuauggacgaacuccacaaugagauccuggagcuugaugaaaagguggacgaucugcgggccgacacaauuagcucucagaucgagcucgcgguccugcuuagcaacgaaggaauuaucaauuccgaggaugaacaucugcucgcucuggagcgcaaacugaagaaaaugcucggccccucugccguggacauugggaacggcuguuucgagaccaagcacaagugcaaucagacaugccuggauagaaucgccgcuggaaccuuuaacgccggcgaguucagccuuccuacguuugacucccugaauaucaccgcugccagccucaacgaugacgggcuggauaaucacacaauucugcuuuauuacucuaccgcggccuccagccucgcuguuacacugaugcuggccaucuucauuguguauauggucucucgggacaacguguccuguagcaucugccucuga

SEQ ID NO: 209637 - RNA, 1755 nt, Artificial Sequence; identical to SEQ ID NO: 209450
  derived and/or modified sequence opt5 from hemagglutinin__InfluenzaB__AEO80108

SEQ ID NO: 209638 - RNA, 1758 nt, Artificial Sequence; identical to SEQ ID NO: 209538
  derived and/or modified sequence opt5 from hemagglutinin__InfluenzaB__AEO80145

SEQ ID NO: 209639 - RNA, 1758 nt, Artificial Sequence; identical to SEQ ID NO: 209597
  derived and/or modified sequence opt5 from hemagglutinin__InfluenzaB__AEO80154

SEQ ID NO: 209640 - RNA, 1758 nt, Artificial Sequence
  derived and/or modified sequence opt5 from hemagglutinin__InfluenzaB__AEO80183
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaucgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaauuguggucgauuauauggugcagaagucugggaaaacaggaaccaucaccuaccaacggggcauucuccugccccagaagguuuggugcgccuccgggcgcagcaaagugaucaagggaucccuuccucugauuggcgaagcugacugucuccaugagaaauauggcgggcugaacaagucuaaacccuacuacacaggagagcacgccaaggcgaucggcaauugccccaucugggucaagaccccucugaaacucgccaacgggacaaaguauagaccgcccgcuaaacugcuuaaggaacggggauuuuucggcgccauugcuggguuucuggagggcggaugggaaggcaugaucgccggguggcauggauacacgagccacggcgcccacgggguggcuguugcggccgaucucaaauccacccaggaggcuauuaauaagaucacaaagaaccugaauagccuuucugaacuggaggugaaaaaccuccagcgccuguccggagccauggacgagcugcauaaugaaauucucgagcuggaugaaaaggucgacgaccuuagagccgauaccaucagcucucaaaucgagcuggcugugcuccugagcaacgaaggcauuaucaauuccgaggacgagcaccuucuggcccucgaacggaaacugaagaaaaugcuggggccuucugcggucgagauuggcaacggauguuucgaaacaaagcauaagugcaaucagaccugccucgaucgcaucgcugccggcacguuugacgccggggaguucagccugcccaccuuugauucccuuaacauuacagcugccagccugaaugacgauggacucgacaaccacaccauccugcuguauuacucuacagcugccuccagccuugcggugacccucaugauugccaucuucguuguguauauggucucuagagauaacguguccuguagcaucugccuguga

SEQ ID NO: 209641 - RNA, 1758 nt, Artificial Sequence
  derived and/or modified sequence opt5 from hemagglutinin__InfluenzaB__AEO80194
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaagcccagauggcuaaacuuuauggggauuccaagccccagaaguuuacaagcucugccaauggaguuaccacacacuacgugucccaaaucggcggcuucccgaaccagaccgaggacgggggacugccucagagcggcagaaucguggucgauuauauggugcagaagucugggaaaacgggaacaauuaccuaccaacggggcauccuccugccccagaagguuuggugcgcucgcgggagauccaaagugauuaagggaagccuuccucugaucggcgaagccgacugucuccaugagaaauauggcgggcugaauaaguccaaacccuacuacaccggagagcacgcgaaggccauuggcaacugccccaucugggucaagacaccucugaaacucgcuaaugggaccaaguaucggccgcccgccaaacugcuuaaggaacgcggauuuuucggcgcuaucgccggguuucuggagggcggaugggaaggcaugauugccggguggcauggauacacaucucacggcgcucacgggguggcgguugccgcugaucucaaaagcacgcaggaggccaucaacaagauuaccaagaaucugaacucccuuagcgaacuggaggugaaaaaucuccagagacugucuggagccauggacgagcugcauaacgaaauccucgagcuggaugaaaaggucgacgaccuucgggcugauacaauuuccagccaaaucgagcuggccgugcuccugucuaaugaaggcaucauuaacagcgaggacgagcaccuucuggcgcucgaacgcaaacugaagaaaaugcuggggccuuccgcugucgagaucggcaauggauguuucgaaaccaagcauaagugcaaccagacaugccucgauagaauugccgccggcaccuuugacgcuggggaguucucucugcccacguuugauagccuuaauaucaccgccgcuucccugaacgacgauggacucgacaaccacacaauucugcuguauuacagcaccgccgcgucuucccuugccgugacacucaugaucgcuauuuucguuguguauaugaucagccgggauaaugucucuuguuccaucugccuguga

SEQ ID NO: 209642 - RNA, 1758 nt, Artificial Sequence; identical to SEQ ID NO: 209589
  derived and/or modified sequence opt5 from hemagglutinin__InfluenzaB__AEO80205

SEQ ID NO: 209643 - RNA, 1758 nt, Artificial Sequence; identical to SEQ ID NO: 209589
  derived and/or modified sequence opt5 from hemagglutinin__InfluenzaB__AEO80216

SEQ ID NO: 209644 - RNA, 1755 nt, Artificial Sequence
  derived and/or modified sequence opt5 from hemagglutinin__InfluenzaB__AEO80227
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagauucagaugaaaaaccuguacggcgauagcaauccccaaaaguuuacaucuuccgcuaacgggguuaccacacacuaugugagccagaucggaggcuucccggaccagaccgaggauggcgggcucccucagucuggacggauuguggucgacuacaugaugcaaaagcccggcaaaacggggacaaucguguaucagcgcggaguucugcuuccucagaagguguggugcgccuccggcagaagcaaagucaucaaggggucccugccccucauuggagaagcggauugucugcaugagaaauacggcggccugaacaagucuaaacccuacuauaccggggaacacgccaaggcuaucggaaauugcccuauuugggugaagaccccgcucaaacuggccaacggcacaaaguaccggcccccugcuaaacuucugaaggagcgcggguuuuucggagccaucgccggcuuucucgaagggggcugggaaggaaugauugcuggcuggcacggguauaccagccauggagcgcacggcguugccguggcugccgaccugaaauccacacaggaggccaucaauaagaucacgaagaaccuuaauagccugucugaacucgaggucaaaaaccugcaaagacuguccggggcuauggacgaacuccauaaugagauucuggagcuugaugaaaagguggacgaucugcgggccgacaccaucagcucucagauugagcucgcgguccugcuuagcaacgaaggaaucauuaauuccgaggaugaacaucugcucgcucuggagcgcaaacugaagaaaaugcucggccccucugccguggacaucgggaacggcuguuucgagacaaagcacaagugcaaucagaccugccuggauagaaucgccgcuggaacauuuaacgccggcgaguucagccuuccuaccuuugacucccugaauauuacggcugccagccucaacgaugacgggcuggauaaucacaccauccugcuuuacuauucuacagcggccuccagccucgcuguuacccugaugcuggccauuuucaucguguacauggucucucgggacaacguguccuguagcauuugccucuga

SEQ ID NO: 209645 - RNA, 1758 nt, Artificial Sequence; identical to SEQ ID NO: 209606
  derived and/or modified sequence opt5 from hemagglutinin__InfluenzaB__AEO80238

SEQ ID NO: 209646 - RNA, 1758 nt, Artificial Sequence
  derived and/or modified sequence opt5 from hemagglutinin__InfluenzaB__AEP20178
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugccucaacuguacagaucuggacguggcgcuuggacgcccuaagugcaccggcaauauucccagcgcuagagucuccauccugcacgaggugcggccuguuacaucuggguguuuucccaucaugcaugaucgcaccaagauuagacaacucccuaaccugcugcggggauacgaacacauccgccucagcacgcauaaugugauuaacgccgagaaugccccgggcggccccuauaaaaucgggacauccggaagcugcccuaacgucaccaauggcaacggguucuuugcuacaauggccugggcugugcccaagaaugacaacaauaaaaccgccaccaacucucugacaauugaagugccuuacaucuguacggagggagaggaucagauuaccgucuggggcuuccacuccgacaacgaaacacagauggcgaaacuuuauggggauagcaagccccagaaguuuaccucuuccgccaauggaguuacaacccacuacgugagccaaaucggcggcuucccgaaccagacggaggacgggggacugccucagucuggcagaaucguggucgauuauauggugcagaaguccgggaaaacaggaaccauuaccuaccaacggggcauccuccugccccagaagguuuggugcgcuagcgggcgcuccaaagugauuaagggaucucuuccucugaucggcgaagccgacugucuccaugagaaauauggcgggcugaauaagagcaaacccuacuacacaggagagcacgcuaaggccauuggcaacugccccaucugggucaagaccccucugaaacucgcgaaugggacaaaguauagaccgcccgccaaacugcuuaaggaacggggauuuuucggcgcuaucgccggguuucuggagggcggaugggaaggcaugauugcuggguggcauggauacacgucccacggcgcccacgggguggccguugcugcggaucucaaaagcacccaggaggccaucaacaagauuacaaagaaucugaacucucuuuccgaacuggaggugaaaaaucuccagcgccugagcggagcuauggacgagcugcauaacgaaauccucgagcuggaugaaaaggucgacgaccuuagagccgauaccauuucuagccaaaucgagcuggccgugcuccuguccaaugaaggcaucauuaacucugaggacgagcaccuucuggcucucgaacggaaacugaagaaaaugcuggggccuagcgccgucgagaucggcaauggauguuucgaaacaaagcauaagugcaaccagaccugccucgaucgcauugcggcuggcacguuugacgccggggaguucucccugcccaccuuugauagccuuaauaucacagccgcuucucugaacgacgauggacucgacaaccacaccauucugcuguauuacuccacagccgcuagcucucuugccgugacccucaugaucgcgauuuucguuguguauauggucuccagagauaaugugagcuguuccaucugccuguga

SEQ ID NO: 209647 - RNA, 1758 nt, Artificial Sequence
  derived and/or modified sequence opt5 from hemagglutinin__InfluenzaB__AEP20189
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccgugcugcuguauuacucuacagcugccuccagccuugcgguuacccucaugauugccaucuucguggucuauauggugucuagagauaauguuuccuguagcauuugccuguga

SEQ ID NO: 209648 - RNA, 1758 nt, Artificial Sequence; identical to SEQ ID NO: 209538
  derived and/or modified sequence opt5 from hemagglutinin__InfluenzaB__AEP20200

SEQ ID NO: 209649 - RNA, 1755 nt, Artificial Sequence; identical to SEQ ID NO: 209429
  derived and/or modified sequence opt5 from hemagglutinin__InfluenzaB__AEP20211

SEQ ID NO: 209650 - RNA, 1755 nt, Artificial Sequence
  derived and/or modified sequence opt5 from hemagglutinin__InfluenzaB__AEP20222
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugcuuuaacuguaccgaucucgacguugcccugggacgcccuaugugcgugggcauuacacccucugccaaggcuagcauccuucacgaagucagaccugugaccuccggguguuuccccaucaugcaugaucggacgaagauucgccaacugccuaaucuccugagaggauacgagaaaauccggcugucuacacagaacguuauugacgccgaaaaggcuccgggcggccccuaucgccucgggaccagcggauccugcccuaaugccacaagcaaaucuggcuuuuucgcgaccauggccugggcugugcccagagauaacaauaagaccgccacaaacccucugacggucgaggugcccaauaucuguaccaaagaagaggaccagauuacaguguggggguuucacuccgauaacaagacccagaugaagaaucuuuacggagacccgaacccucaaaaauucacaagcucugcuaauggcaucaccacgcauuaugucucccagauugggggauuucccgaucagacagaggacggcggccugccucagagcgggcggaucguuguggauuacauggugcaaaagcccggaaaaaccggcaccaucgucuaucagcgcgggauucuccugccccagaagguguggugcgccucuggaagauccaaaguuaucaagggcagccuuccucugauuggggaagcggacugucuccacgagaaauacggaggccugaacaaguccaagccguauuacacaggcgaacacgccaaagcuaucgggaacugccccauuugggugaagaccccucugaaacucgccaauggaacaaaguaccggcccccugcuaaacugcuuaaggagcgcggcuucuuuggggccaucgccggauuccuggagggcgggugggaaggcaugaucgcuggauggcauggcuauacgucucacggggcgcauggagucgccguggcugccgaucucaagagcacccaggaggccauuaacaaaaucacaaagaaucugaacucccuuagcgaacuggagguuaaaaaucuccaaagacugucuggcgcuauggacgaacugcacaacgagauucucgagcuggacgaaaagguggaugaccuucgggccgauaccaucuccagccagauugagcuggcgguccuccugucuaaugaagggaucaucaacagcgaggacgaacaccuucuggcucucgagcgcaaacugaagaagaugcugggacccuccgccguggauauuggcaauggguguuuugagacaaaacauaagugcaaccagaccugccucgacagaaucgccgcuggcacguucaaugccggagaauuuucucugccgaccuucgauagccuuaacauuacagcugccucccugaaugacgauggccucgacaaccacaccauccugcuguacuauagcacagcggccucuucccuugcugucacccucaugauugccaucuucauuguguacaugaucagccgggauaauguuucuuguuccaucugccuguga

SEQ ID NO: 209651 - RNA, 1755 nt, Artificial Sequence; identical to SEQ ID NO: 209535
  derived and/or modified sequence opt5 from hemagglutinin__InfluenzaB__AEP20233

SEQ ID NO: 209652 - RNA, 1755 nt, Artificial Sequence
  derived and/or modified sequence opt5 from hemagglutinin__InfluenzaB__AEP20244
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugcuuuaacuguaccgaucucgacguugcccugggacgcccuaugugcaugggcauuacacccucugccaaggcuagcauccuucacgaagugagaccugucaccuccggguguuuccccaucaugcaugaucggacgaagauucgccaacugccuaaucuccugagaggauacgagaaaauccggcugucuacacagaacgugauugacgccgaaaaggcuccgggcggccccuaucgccucgggaccagcggauccugcccuaaugccacaagcaaaucuggcuuuuucgcgaccauggccugggcuguucccagagggaacaauaagaccgccacaaacccucugacgguggaggucccccacaucuguaccaaagaagaggaucagauuacaguguggggauuucauuccgacaauaagacccagaugaagaaccuuuacggcgauagcaauccgcaaaaauucacaucuuccgcuaacgggaucaccacgcacuaugugagccagauuggaggcuuuccugaccagacagaggauggcgggcugccccagucuggacggaucgucguugacuacauggugcaaaagccuggcaaaaccgggaccaucguguaucagcgcgggauucuccugccccagaaggucuggugcgccuccggcagaagcaaagugaucaaggggucccuuccccugauuggagaagcggauugucuccacgagaaauacggcggccugaauaagucuaagccuuauuacacaggggaacaugccaaagcuaucggaaacugcccgauuuggguuaagacaccccugaaacucgccaacggcaccaaguaccggccucccgcuaaacugcuuaaggagcgcggguucuuuggagccaucgccggcuuccuggagggaggcugggaaggaaugaucgcuggcuggcacggguauacgagccauggagcgcacggcguggccgucgcugccgaccucaaguccacccaggaggccauuaauaaaaucacaaagaaccugaauagccuuucugaacuggaggugaaaaaccuccaaagacuguccggggcuauggaugaacugcacaaugagauucucgagcuggacgaaaagguugacgaucuucgggccgacaccaucagcucucagauugagcuggcggugcuccugagcaacgaaggaaucaucaauuccgaggaugaacaucuucuggcucucgagcgcaaacugaagaagaugcugggcccuucugccgucgacauugggaacggcuguuuugagacaaaacacaagugcaaucagaccugccucgauagaaucgccgcuggaacguucaacgccggcgaauuuagccugcccaccuucgacucccuuaauauuacagcugccagccugaacgaugacgggcucgauaaucauaccauccugcuguacuauucuacagcggccuccagccuugcugugacccucaugauugccaucuucauugucuacaugaucucucgggacaacguguccuguagcaucugccuguga

SEQ ID NO: 209653 - RNA, 1758 nt, Artificial Sequence; identical to SEQ ID NO: 209443
  derived and/or modified sequence opt5 from hemagglutinin__InfluenzaB__AEP20255

SEQ ID NO: 209654 - RNA, 1758 nt, Artificial Sequence
  derived and/or modified sequence opt5 from hemagglutinin__InfluenzaB__AEP20277
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaagcugacugucuccaugagaaauauggcgggcugaacaagucuaagcccuacuacacaggagagcacgccaaagcgauuggcaauugccccaucugggucaagaccccucugaaacucgccaacgggacaaaguaucgcccgcccgcuaaacugcuuaaggaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaauaaaauuacaaagaaccugaauagccuuucugaacuggaggugaaaaaccuccagcggcuguccggagccauggacgagcugcauaaugaaauccucgagcuggaugaaaaggucgacgaccuucgcgccgauaccauuagcucucaaaucgagcuggcugugcuccugagcaacgaaggcaucauuaauuccgaggacgagcaccuucuggcccucgaaagaaaacugaagaagaugcuggggccuucugcggucgagaucggcaacggauguuucgaaacaaaacauaagugcaaucagaccugccucgauaaaauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgggauaacguguccuguagcaucugccuguga

SEQ ID NO: 209655 - RNA, 1755 nt, Artificial Sequence
  derived and/or modified sequence opt5 from hemagglutinin__InfluenzaB__AEP20299
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaagaauaacaauaaaaacgccaccaauccccuuacaguggaggugccuuauauuuguacggaaggggaggaccagaucaccgucuggggauuccauuccgauaacaagacacagaugaaaaaucuguacggcgacagcaacccccaaaaguuuaccucuuccgcuaacgggguuacaacccacuaugugagccagauuggaggcuucccggaucagacggaggacggcgggcucccucagucuggacggaucguggucgauuacaugaugcaaaagcccggcaaaacagggaccauuguguaucagcgcggaguucugcuuccucagaagguguggugcgccuccggcagaagcaaagucaucaaggggucccugccccucaucggagaagcggacugucugcaugagaaauacggcggccugaauaagucuaaacccuacuauaccggggaacacgccaaggcuauuggaaacugcccuaucugggugaagacaccgcucaaacuggccaauggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaucugaaauccacgcaggaggccauuaacaagaucaccaagaaucuuaacagccugucugaacucgaggucaaaaaucugcaaagacuguccggggcuauggacgaacuccauaacgagauccuggagcuugacgaaaagguggaugaccugcgggccgauacaauuagcucucagaucgagcucgcgguccugcuuagcaaugaaggaauuaucaacuccgaggacgaacaucugcucgcucuggagcgcaaacugaagaaaaugcucggccccucugccguggauauugggaauggcuguuucgagaccaagcacaagugcaaccagacaugccuggacagaaucgccgcuggaaccuuuaaugccggcgaguucagccuuccuacguuugauucccugaacaucaccgcugccagccucaaugacgaugggcuggacaaccacacaauucugcuuuacuauucuaccgcggccuccagccucgcuguuacacugaugcuggccaucuucauuguguacauggucucucgggauaacguguccuguagcaucugccucuga

SEQ ID NO: 209656 - RNA, 1755 nt, Artificial Sequence
  derived and/or modified sequence opt5 from hemagglutinin__InfluenzaB__AEP20310
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacagcucacuaugugagccagauuggaggcuucccugaccagaccgaggauggcgggcucccccagucuggacggaucguggucgacuacaugaugcaaaagccuggcaaaacggggacaauuguguaucagcgcggaguucugcuuccccagaagguguggugcgccuccggcagaagcaaagucaucaaggggucccugccccucaucggagaagcggauugucugcaugagaaauacggcggccugaacaagucuaaaccuuacuauaccggggaacacgccaaggcuauuggaaauugcccgaucugggugaagacaccccucaaacuggccaacggcaccaaguaccggccucccgcuaaacuucugaaggagcgcggguuuuucggagccauugccggcuuucucgaagggggcugggaaggaaugaucgcuggcuggcacggguauaccagccauggagcgcacggcguugccguggcugccgaccugaaauccacacaggaggccauuaauaagaucacgaagaaccuuaauagccugucugaacucgaggucaaaaaccugcaaagacuguccggggcuauggacgaacuccauaaugagauccuggagcuugaugaaaagguggacgaucugcgggccgacaccauuagcucucagaucgagcucgcgguccugcuuagcaacgaaggaauuaucaauuccgaggaugaacaucugcucgcucuggagcgcaaacugaagaaaaugcucggcccuucugccguggacauugggaacggcuguuucgagacaaagcacaagugcaaucagaccugccuggauagaaucgccgcuggaacauuuaacgccggcgaguucagccuucccaccuuugacucccugaauaucacggcugccagccucaacgaugacgggcuggauaaucacaccauucugcuuuacuauucuacagcggccuccagccucgcuguuacccugaugcuggccaucuucauuguguacauggucucucgggacaacguguccuguagcaucugccucuga

SEQ ID NO: 209657 - RNA, 1758 nt, Artificial Sequence
  derived and/or modified sequence opt5 from hemagglutinin__InfluenzaB__AEP20332
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauccucugacaauugaagugcccuacaucuguacggagggagaggaucagauuaccgucuggggcuuccacagcgacaacgaaacacagauggccaagcuguauggggauucuaagccgcagaaauuuaccuccagcgcuaacggaguuacaacccacuacgugucucaaaucggcggcuucccuaaucagacggaggacgggggacugccccaguccggccgcaucguggucgauuauauggugcaaaagagcgggaaaacaggaaccauuaccuaccagagaggcauccuccugccucagaagguuuggugcgccucugggcgguccaaagugauuaagggaagccuuccccugaucggcgaagcugacugucuccaugagaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggaacgcggauuuuucggcgccaucgcuggguuucuggagggcggaugggaaggcaugauugccggguggcauggauacacgucucacggcgcccacgggguggcuguugcggccgaucucaagagcacccaggaggcuaucaauaaaauuacaaagaaccuuaauucccuuagcgaacuggaggugaaaaaccuccagcggcugucuggagccauggacgagcugcauaaugaaauccucgagcuggaugaaaaggucgacgaccuucgcgccgauaccauuuccagccaaaucgagcuggcugugcuccugucuaacgaaggcaucauuaauagcgaggacgagcaccuucuggcccucgaaagaaaacugaagaagaugcuggggcccuccgcggucgagaucggcaacggauguuucgaaacaaaacauaagugcaaucagaccugccucgaucggauugcugccggcacguuugacgccggggaguucucucugccuaccuuugauagccuuaacaucacagcugccucccugaaugacgauggacucgacaaccacaccauucugcuguauuacagcacagcugccucuucccuugcggugacccucaugaucgccauuuucguuguguauauggucagccgcgauaacgugucuuguuccaucugccuguga

SEQ ID NO: 209658 - RNA, 1755 nt, Artificial Sequence; identical to SEQ ID NO: 209450
  derived and/or modified sequence opt5 from hemagglutinin__InfluenzaB__AEP20343

SEQ ID NO: 209659 - RNA, 1755 nt, Artificial Sequence; identical to SEQ ID NO: 209450
  derived and/or modified sequence opt5 from hemagglutinin__InfluenzaB__AEP20354

SEQ ID NO: 209660 - RNA, 1755 nt, Artificial Sequence; identical to SEQ ID NO: 209450
  derived and/or modified sequence opt5 from hemagglutinin__InfluenzaB__AEP20365

SEQ ID NO: 209661 - RNA, 1755 nt, Artificial Sequence; identical to SEQ ID NO: 209450
  derived and/or modified sequence opt5 from hemagglutinin__InfluenzaB__AEP20376

SEQ ID NO: 209662 - RNA, 1758 nt, Artificial Sequence
  derived and/or modified sequence opt5 from hemagglutinin__InfluenzaB__AEP20398
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcggcuguccggagccauggacgagcugcauaaugaaauucucgagcuggaugaaaagguggacgaccuucgcgccgauaccaucagcucucaaaucgagcuggcuguccuccugagcaacgaaggcauuaucaauuccgaggacgagcaccuucuggcccucgaaagaaaacugaagaagaugcuggggccuucugcgguggagauuggcaacggauguuucgaaacaaaacauaagugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauugccaucuucgugguuuauauggugucucgcgauaacgucuccuguagcaucugccuguga

SEQ ID NO: 209663 - RNA, 1758 nt, Artificial Sequence; identical to SEQ ID NO: 209632
  derived and/or modified sequence opt5 from hemagglutinin__InfluenzaB__AEP20409

SEQ ID NO: 209664 - RNA, 1758 nt, Artificial Sequence; identical to SEQ ID NO: 209632
  derived and/or modified sequence opt5 from hemagglutinin__InfluenzaB__AEP20420

SEQ ID NO: 209665 - RNA, 1758 nt, Artificial Sequence; identical to SEQ ID NO: 209632
  derived and/or modified sequence opt5 from hemagglutinin__InfluenzaB__AEP20431

SEQ ID NO: 209666 - RNA, 1758 nt, Artificial Sequence; identical to SEQ ID NO: 209632
  derived and/or modified sequence opt5 from hemagglutinin__InfluenzaB__AEP20442

SEQ ID NO: 209667 - RNA, 1758 nt, Artificial Sequence; identical to SEQ ID NO: 209632
  derived and/or modified sequence opt5 from hemagglutinin__InfluenzaB__AEP20453

SEQ ID NO: 209668 - RNA, 1755 nt, Artificial Sequence; identical to SEQ ID NO: 209450
  derived and/or modified sequence opt5 from hemagglutinin__InfluenzaB__AEQ39027

SEQ ID NO: 209669 - RNA, 1758 nt, Artificial Sequence
  derived and/or modified sequence opt5 from hemagglutinin__InfluenzaB__AEQ39260
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagcagagauaacgugucuuguuccaucugccuguga

SEQ ID NO: 209670 - RNA, 1758 nt, Artificial Sequence; identical to SEQ ID NO: 209669
  derived and/or modified sequence opt5 from hemagglutinin__InfluenzaB__AEQ39271

SEQ ID NO: 209671 - RNA, 1758 nt, Artificial Sequence
  derived and/or modified sequence opt5 from hemagglutinin__InfluenzaB__AEQ39282
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacggagacgaacucgauaaucacaccauucugcuguauuacagcacagcugccucuucccuugcggugacccucaugaucgccauuuucguuguguauauggucagcagagacaacgugucuuguuccaucugccuguga

SEQ ID NO: 209672 - RNA, 1758 nt, Artificial Sequence
  derived and/or modified sequence opt5 from hemagglutinin__InfluenzaB__AEQ39315
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacggagacggccucgauaaucacaccauucugcuguauuacagcacagcugccucuucccuugcggugacccucaugaucgccauuuucguuguguauauggucagcagagacaacgugucuuguuccaucugccuguga

SEQ ID NO: 209673 - RNA, 1758 nt, Artificial Sequence; identical to SEQ ID NO: 209672
  derived and/or modified sequence opt5 from hemagglutinin__InfluenzaB__AEQ39326

SEQ ID NO: 209674 - RNA, 1758 nt, Artificial Sequence
  derived and/or modified sequence opt5 from hemagglutinin__InfluenzaB__AEQ39337
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccggcaacgcuccgggcgggcccuauaagaucggaacaagcggcuccugcccuaaugucaccaacgggaauggauucuuugccacaauggcuugggccgugcccaaaaacgacaagaauaaaaccgcgaccaacccucugacaauugaggugcccuacaucuguacggaaggcgaggaucagauuaccgucuggggguuccacagcgacaaugagacacagauggccaaacuuuauggagauucuaagccgcagaaguuuaccuccagcgcuaacggcguuacaacccacuacgugucucaaaucggcggguucccuaaccagacggaagacggaggccugccccaguccgggagaaucguggucgauuauauggugcaaaagagcggaaaaacaggcaccauuaccuaccagcgggggauccuccugccucagaagguuuggugcgccucuggacgcuccaaagugauuaagggcagccuuccccugaucggcgaggcugacugucuccaugaaaaauaugggggacugaauaaguccaagcccuacuacacaggcgagcacgccaaagcgauugggaacugcccuaucugggucaagaaaccgcugaagcucgccaauggaaccaaauauagacccccugcuaagcugcuuaaggagcggggcuuuuucggggccaucgcuggcuuucuggaaggaggcugggaggggaugauugccggauggcauggcuacacaucucacggggcccacggaguggcuguugcggccgaucucaaaagcacgcaggaagcuaucaacaagauuaccaaaaaucugaacucccuuagcgagcuggaagugaagaaucuccagcgccugucuggcgccauggacgagcugcauaacgagauccucgaacuggaugagaaagucgacgaccuuagagccgauacaauuuccagccaaaucgaacuggcugugcuccugucuaaugaggggaucauuaacagcgaagacgagcaccuucuggcccucgagcggaagcugaagaaaaugcugggccccuccgcggucgaaaucggaaauggcuguuucgagaccaagcauaaaugcaaccagacaugccucgaucgcauugcugccgggaccuuugacgccggagaguucucucugccuacguuugauagccuuaauaucaccgcugccucccugaacgacgauggccucgacaaucacacaauucugcuguauuacagcaccgcugccucuucccuugcggugacacucaugaucgccauuuucguuguguauauggucagcagagauaacgugucuuguuccaucugccuguga

SEQ ID NO: 209675 - RNA, 1758 nt, Artificial Sequence
  derived and/or modified sequence opt5 from hemagglutinin__InfluenzaB__AEQ39348
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacauuauccugcuguauuacagcaccgcugccucuucccuugcggugacacucaugauugccaucuucguuguguauauggucagcagagauaacgugucuuguuccaucugccuguga

SEQ ID NO: 209676 - RNA, 1758 nt, Artificial Sequence; identical to SEQ ID NO: 209672
  derived and/or modified sequence opt5 from hemagglutinin__InfluenzaB__AEQ39359

SEQ ID NO: 209677 - RNA, 1758 nt, Artificial Sequence
  derived and/or modified sequence opt5 from hemagglutinin__InfluenzaB__AEQ39370
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaauguggucaacgccgagaaugcuccgggcggccccuauaaaauugggacaagcggauccugcccuaacgugaccaauggcaacggguucuuugccacaauggcuugggccgugcccaagaaugacaacaauaaaaccgcgaccaacagccugacaaucgaagucccuuacauuuguacggagggagaggaucagaucaccguuuggggcuuccacucugacaacgaaacacagauggccaaacuuuauggggauuccaagccccagaaguuuaccagcucugcuaauggagugacaacccacuacgugucccaaauuggcggcuucccgaaccagacggaggacgggggacugccucagagcggcagaaucgucguggauuauaugguucagaagucugggaaaacaggaaccaucaccuaccaacggggcauucuccugccccagaagguguggugcgccuccgggcgcagcaaagucaucaagggaucccuuccucugauuggcgaagcugacugucuccaugagaaauauggcgggcugaauaagucuaaacccuacuacacaggagagcacgccaaggcgaucggcaacugccccauuugggugaagaccccucugaaacucgccaaugggacaaaguauagaccgcccgcuaaacugcuuaaggaacggggauuuuucggcgccaucgcuggguuucuggagggcggaugggaaggcaugaucgccggguggcauggauacacgagccacggcgcccacgggguugcuguggcggccgaucucaaauccacccaggaggcuauuaacaagaucacaaagaaucugaacagccuuucugaacuggaggucaaaaaucuccagcgccuguccggagccauggacgagcugcauaacgaaauucucgagcuggaugaaaagguggacgaccuuagagccgauaccaucagcucucaaauugagcuggcuguccuccugagcaaugaaggcaucaucaacuccgaggacgagcaccuucuggcccucgaacggaaacugaagaaaaugcuggggccuucugcgguggagauuggcaauggauguuucgaaacaaagcauaagugcaaccagaccugccucgaucgcaucgcugccggcacguuugacgccggggaguucagccugcccaccuuugauucccuuaauauuacagcugccagccugaacgacgauggacucgacaaccacaccauccugcuguauuacucuacagcugccuccagccuugcgguuacccucaugauugccaucuucguggucuauauggugucuagagauaauguuuccuguagcauuugccuguga

SEQ ID NO: 209678 - RNA, 1755 nt, Artificial Sequence; identical to SEQ ID NO: 209450
  derived and/or modified sequence opt5 from hemagglutinin__InfluenzaB__AEQ39392

SEQ ID NO: 209679 - RNA, 1755 nt, Artificial Sequence; identical to SEQ ID NO: 209450
  derived and/or modified sequence opt5 from hemagglutinin__InfluenzaB__AEQ39429

SEQ ID NO: 209680 - RNA, 1755 nt, Artificial Sequence; identical to SEQ ID NO: 209450
  derived and/or modified sequence opt5 from hemagglutinin__InfluenzaB__AEQ39440

SEQ ID NO: 209681 - RNA, 1755 nt, Artificial Sequence; identical to SEQ ID NO: 209450
  derived and/or modified sequence opt5 from hemagglutinin__InfluenzaB__AEQ39451

SEQ ID NO: 209682 - RNA, 1758 nt, Artificial Sequence; identical to SEQ ID NO: 209662
  derived and/or modified sequence opt5 from hemagglutinin__InfluenzaB__AEQ39462

SEQ ID NO: 209683 - RNA, 1758 nt, Artificial Sequence; identical to SEQ ID NO: 209669
  derived and/or modified sequence opt5 from hemagglutinin__InfluenzaB__AEQ39484

SEQ ID NO: 209684 - RNA, 1755 nt, Artificial Sequence; identical to SEQ ID NO: 209429
  derived and/or modified sequence opt5 from hemagglutinin__InfluenzaB__AEQ39506

SEQ ID NO: 209685 - RNA, 1758 nt, Artificial Sequence
  derived and/or modified sequence opt5 from hemagglutinin__InfluenzaB__AEQ39517
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcggcuguccggagccauggacgagcugcauaaugaaauucucgagcuggaugaaaagguggacgaccuucgcgccgauaccaucagcucucaaaucgagcuggcuguccuccugagcaacgaaggcauuaucaauuccgaggacgagcaccuucuggcccucgaaagaaaacugaagaagaugcuggggccuucugcgguggagauuggcaacggauguuucgaaacaaaacauaagugcaaucagaccugccucgaucggaucgcugccggcacguuugacgccggggaguucagccugcccaccuuugauucccuuaacauuacagcugccagccugaaugacaacggacucgauaaccacaccauccugcuguauuacucuacagcugccuccagccuugcggucacccucaugauugccaucuucgugguuuauauggugucucgcgacaaugucuccuguagcaucugccuguga

SEQ ID NO: 209686 - RNA, 1758 nt, Artificial Sequence
  derived and/or modified sequence opt5 from hemagglutinin__InfluenzaB__AER27038
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacgaagggagaggaucagauuaccgucuggggcuuccacagcgacaaugagacacagauggccaagcuguauggggauucuaaaccucagaaguuuaccuccagcgcuaacggaguuacaacccacuacgugucucaaaucggcggcuuccccaaccagacggaagacgggggacuuccucaguccggcagaaucguggucgauuauauggugcagaaaagcgggaagacaggaaccauuaccuaccaacggggcauccugcucccccagaaaguuuggugcgccucugggcgcuccaaggugauuaaaggaagccugccccuuaucggcgaggcugacugucugcaugaaaaguauggcgggcucaauaaguccaaaccuuacuacacaggagagcacgccaaggcgauuggcaacugcccgaucugggucaaaacaccccugaagcuggccaaugggacaaaauauagaccucccgcuaagcuccugaaggagcggggauuuuucggcgccaucgcuggguuucuugaaggcggaugggagggcaugauugccggguggcauggauacacgucucacggcgcccacgggaucgcuguggcggccgaucugaaaagcacccaggaagcuauuaacaagaucaccaaaaaucucaacucccugagcgagcuugaaguuaagaaucugcagcgccucucuggagccauggacgagcugcauaacgagauucuggaacucgaugagaaaguggacgaccugagagccgauaccaucuccagccaaaucgaacuugcuguccugcucucuaaugagggcauuaucaacagcgaagacgagcaucugcuugcccuggagcggaagcucaagaaaaugcuggggccuuccgcgguggaaauuggcaauggauguuucgagacaaagcacaaaugcaaccagaccugccuggaucgcaucgcugccggcacguuugacgccggggaguucucucuccccaccuuugauagccugaauauuacagcugccucccuuaacgacgauggacuggacaaucacaccauccuccuguauuacagcacagcugccucuucccuggcggucacccuuaugauugccaucuucgugguuuauauggugagcagagauaacgucucuuguuccaucugccucuga

SEQ ID NO: 209687 - RNA, 1758 nt, Artificial Sequence; identical to SEQ ID NO: 209632
  derived and/or modified sequence opt5 from hemagglutinin__InfluenzaB__AER27060

SEQ ID NO: 209688 - RNA, 1758 nt, Artificial Sequence
  derived and/or modified sequence opt5 from hemagglutinin__InfluenzaB__AET10061
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccaaaaaugcuccgggcggccccuauaagaucgggacaagcggauccugcccuaacgucaccaauggcaacggguucuuugccacaauggcuugggccgugcccaaaaaugacaagaacagaaccgcgaccaauagccugacaauugaggugccuuacaucuguaaagaaggagaggaucagauuacggucuggggcuuccacucugacaacgagacccagauggccaaacuuuauggggauuccaagccccagaaguuuacaagcucugcuaacggaguuaccacacacuacgugucccaaaucggcggcuucccgaaucagaccgaagacgggggacugccucagagcggccggaucguggucgauuauauggugcagaagucugggaaaacgggaacaauuaccuaccaacgcggcauccuccugccccagaagguuuggugcgccuccgggagaagcaaagugauuaagggaucccuuccucugaucggcgaggcugacugucuccaugaaaaauauggcgggcugaacaagucuaagcccuacuacaccggagagcacgccaaagcgauuggcaauugccccaucugggucaagacaccucugaaacucgccaacgggaccaaguaucggccgcccgcuaaacugcuuaaggagcgcggauuuuucggcgccaucgcuggguuucuggaaggcggaugggagggcaugauugccggguggcauggauacacaagccacggcgcccacgggguggcuguugcggccgaucucaaguccacgcaggaagcuaucaauaaaauuaccaagaaccugaauagccuuucugagcuggaagugaaaaaccuccagagacuguccggagccauggacgagcugcauaaugagauccucgaacuggaugagaaggucgacgaccuucgggccgauacaauuagcucucaaaucgaacuggcugugcuccugagcaacgagggcaucauuaauuccgaagacgagcaccuucuggcccucgagcgcaaacugaagaagaugcuggggccuucugcggucgaaaucggcaacggauguuucgagaccaaacauaagugcaaucagacaugccucgauagaauugcugccggcaccuuugacgccggggaguucagccugcccacguuugauucccuuaacaucaccgcugccagccugaaugacgauggacucgacaaccacacaauucugcuguauuacucuaccgcugccuccagccuugcggugacacucaugaucgccauuuucguuguguauauggucucucgggauaacguguccuguagcaucugccuguga

SEQ ID NO: 209689 - RNA, 1755 nt, Artificial Sequence
  derived and/or modified sequence opt5 from hemagglutinin__InfluenzaB__AET10062
augaaggccaucauugugcugcucauggucguuaccagcaacgcugacagaaucugcacaggcauuacguccucuaauagcccccacguggugaaaaccgccacacagggggaagucaacgugaccggaguuaucccucugacaauuaccccgacaaaguccuacuucgcgaaucuuaaaggcacccggacgcgcgggaagcugugucccgauugccucaacuguaccgaccuggauguggcucuuggaagaccuaugugcgucggcacaacccccucugccaaagccagcauccugcaugaagugcggccuguuacauccggguguuuucccaucaugcacgaccgcaccaagauuagacaacucccuaaucugcugcggggauaugagaacauccgccucucuacgcagaaugugauugaugcugaaaaggccccgggcggccccuacagacuggggacaagcggauccugcccuaacgcuaccagcaaaaucggcuucuuugccacaauggcgugggccguccccaaggacaauuauaaaaacgcuaccaauccucuuaccguggaggugcccuacauuuguaaggaaggggaggaucagaucacagucuggggauuccauucugacaacaaaacgcagaugaagaaucuguauggcgauuccaacccgcaaaaguuuaccagcucugccaaugggguuacaacccacuacgugucccagauuggagacuucccugaucagacagaggacggcggccucccccagagcgggcggaucguggucgauuauaugaugcaaaaaccuggaaagaccggcacgaucguguaccagcgcgggguucugcuuccccagaaaguguggugcgcuucuggaagauccaaggucauuaaaggcagccugccccucaucggggaagccgacugucugcaugagaaguacggaggccugaacaaauccaagccuuauuacacaggcgaacacgcgaaggccauugggaacugcccgaucugggugaaaacaccccucaagcuggcuaauggaaccaaauaucggccucccgccaagcugcugaaagagcgcggcuuuuucggggcuauugccggauuucucgagggcgggugggaaggcaugaucgccggauggcacggcuacacaucucauggggcucacggaguugcgguggccgcugaccuuaagagcacccaggaggccaucaacaagauuaccaaaaaucuuaacucccugagcgaacucgaggucaagaaucugcaaagacugucuggcgccauggaugaacuccauaacgagauccuggagcuugacgaaaaaguggaugaccugcgggcugauacgauuuccagccagaucgagcucgccguccugcuuucuaaugaagggauuaucaacagcgaggacgaacaucugcucgcgcuggagcgcaagcugaaaaagaugcucggaccuuccgcuguggauaucggcaauggguguuucgagaccaagcacaaaugcaaccagacaugccuggacagaauugccgccggcaccuuuaaugcuggagaguucucucuucccacauuugauagccugaacaucaccgccgcuucccucaaugacgauggccuggacaaccacacgauucugcuuuauuacagcaccgccgcgucuucccucgccguuacacugaugcuggcuaucuucauuguguauauggucagccgggacaaugugucuuguuccaucugccucuga

SEQ ID NO: 209690 - RNA, 1755 nt, Artificial Sequence
  derived and/or modified sequence opt5 from hemagglutinin__InfluenzaB__AET10064
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccaucuggggauuccauucugacaacaagacacagaugaaaaaucuguauggcgauuccaacccgcaaaaguuuaccagcucugccaauggggucacaacccacuacguuucccagauuggagacuucccugaucagacggaggacggcggccucccccagagcgggcggaucgugguggauuauaugaugcaaaagccuggaaaaacaggcaccaucgucuaccagcgcggggugcugcuuccccagaagguuuggugcgcuucuggaagauccaaagugauuaagggcagccugccccucaucggggaagccgacugucugcaugagaaauacggaggccugaacaaguccaaaccuuauuacaccggcgaacacgcgaaggccauugggaacugcccgaucugggucaagacaccccucaaacuggcuaauggaaccaaguaucggccucccgccaaacuucugaaggagcgcggcuuuuucggggcuauugccggauuucucgagggcgggugggaaggcaugaucgccggauggcacggcuacacaucucauggggcucacggaguggcgguugccgcugaccugaaaagcacgcaggaggccaucaacaagauuaccaagaaucuuaacucccugagcgaacucgaggugaaaaaucugcaaagacugucuggcgccauggaugaacuccauaacgagauccuggagcuugacgaaaaggucgaugaccugcgggcugauacaauuuccagccagaucgagcucgccgugcugcuuucuaaugaagggauuaucaacagcgaggacgaacaucugcucgcgcuggagcgcaaacugaagaaaaugcucggaccuuccgcugucgauaucggcaauggguguuucgagaccaagcacaagugcaaccagacaugccuggacagaauugccgccggcaccuuuaaugcuggagaguucucucuucccacguuugauagccugaacaucaccgccgcuucccucaaugacgauggccuggacaaccacacaauucugcuuuauuacagcaccgccgcgucuucccucgccgugacacugaugcuggcuaucuucauuguuuauauggugagccgggacaaugucucuuguuccaucugccucuga

SEQ ID NO: 209691 - RNA, 1755 nt, Artificial Sequence
  derived and/or modified sequence opt5 from hemagglutinin__InfluenzaB__AET10065
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguaaggaaggggaggaucagauuacggucuggggauuccauucugacaacaaaacccagaugaagaaucuguauggcgauuccaacccgcaaaaguuuacaagcucugccaaugggguuaccacacacuacgugucccagaucggagacuucccugaucagaccgaggacggcggccucccccagagcgggcggauuguggucgauuauaugaugcaaaaaccuggaaagacgggcacaaucguguaccagcgcgggguucugcuuccccagaaaguguggugcgcuucuggaagauccaaggucaucaaaggcagccugccccucauuggggaagccgacugucugcaugagaaguacggaggccugaacaaauccaagccuuauuacaccggcgaacacgcgaaggccaucgggaacugcccgauuugggugaaaacaccccucaagcuggcuaauggaaccaaauaucggccucccgccaagcugcugaaagagcgcggcuuuuucggggcuaucgccggauuucucgagggcgggugggaaggcaugauugccggauggcacggcuacaccucucauggggcucacggaguugcgguggccgcugaccuuaagagcacacaggaggccaucaacaagaucacgaaaaaucuuaacucccugagcgaacucgaggucaagaaucugcaaagacugucuggcgccauggaugaacuccauaacgagauucuggagcuugacgaaaaaguggaugaccugcgggcugauaccaucuccagccagauugagcucgccguccugcuuucuaaugaagggaucauuaacagcgaggacgaacaucugcucgcgcuggagcgcaagcugaaaaagaugcucggaccuuccgcuguggauaucggcaauggguguuucgagacaaagcacaaaugcaaccagaccugccuggacagaaucgccgccggcacauuuaaugcuggagaguucucucuucccaccuuugauagccugaacauuacggccgcuucccucaaugacgauggccuggacaaccacaccauccugcuuuauuacagcacagccgcgucuucccucgccguuacccugaugcuggcuauuuucaucguguauauggucagccgggacaaugugucuuguuccauuugccucuga

SEQ ID NO: 209692 - RNA, 1755 nt, Artificial Sequence; identical to SEQ ID NO: 209691
  derived and/or modified sequence opt5 from hemagglutinin__InfluenzaB__AET10066

SEQ ID NO: 209693 - RNA, 1755 nt, Artificial Sequence
  derived and/or modified sequence opt5 from hemagglutinin__InfluenzaB__AET10067
augaaggccaucauugugcugcucauggucguuaccagcaacgcugacagaaucugcacaggcauuacguccucuaauagcccccacguggugaaaaccgccacacagggggaagucaacgugaccggaguuaucccucugacagcgaccccgacaaaguccuacuucgcuaaucuuaaaggcacccggacgcgcgggaagcugugucccgauugccucaacuguaccgaccuggauguggcccuuggaagaccuaugugcgucggcacaacccccucugccaaagcuagcauucugcaugaagugcggccuguuacauccggguguuuucccaucaugcacgaccgcaccaagaucagacaacucccuaaucugcugcggggauaugagaacauucgccucucuacgcagaaugugaucgaugccgaaaaggcuccgggcggccccuacagacuggggacaagcggauccugcccuaacgccaccagcaaaauuggcuucuuugcgacaauggccugggcuguccccaaggacaauuauaaaaacgccaccaauccucuuaccguggaggugcccuacaucuguaaggaaggggaggaucagauuacagucuggggauuccauucugacaacaaaacgcagaugaagaaucuguauggcgauuccaacccgcaaaaguuuaccagcucugcuaaugggguuacaacccacuacgugucccagaucggagacuucccugaucagacagaggacggcggccucccccagagcgggcggauuguggucgauuauaugaugcaaaaaccuggaaagaccggcacgaucguguaccagcgcgggguucugcuuccccagaaaguguggugcgccucuggaagauccaaggucaucaaaggcagccugccccucauuggggaagcggacugucugcaugagaaguacggaggccugaacaaauccaagccuuauuacacaggcgaacacgccaaggcuaucgggaacugcccgauuugggugaaaacaccccucaagcuggccaauggaaccaaauaucggccucccgcuaagcugcugaaagagcgcggcuuuuucggggccaucgccggauuucucgagggcgggugggaaggcaugauugcuggauggcacggcuacacaucucauggggcgcacggaguugccguggcugccgaccuuaagagcacccaggaggccaucaacaagaucaccaaaaaucuuaacucccugagcgaacucgaggucaagaaucugcaaagacugucuggcgcuauggaugaacuccauaacgagauucuggagcuugacgaaaaaguggaugaccugcgggccgauacgaucuccagccagauugagcucgcgguccugcuuucuaaugaagggaucauuaacagcgaggacgaacaucugcucgcucuggagcgcaagcugaaaaagaugcucggaccuuccgccguggauaucggcaauggguguuucgagaccaagcacaaaugcaaccagacaugccuggacagaaucgccgcuggcaccuuuaaugccggagaguucucucuucccacauuugauagccugaacauuaccgcugccucccucaaugacgauggccuggacaaccacacgauccugcuuuauuacagcaccgcggccucuucccucgcuguuacacugaugcuggccauuuucaucguguauauggucagccgggacaaugugucuuguuccauuugccucuga

SEQ ID NO: 209694 - RNA, 1755 nt, Artificial Sequence
  derived and/or modified sequence opt5 from hemagglutinin__InfluenzaB__AET10068
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccgcgccgacaaaguccuacuucgcuaaucuuaaaggcacccggacgcgcgggaagcugugucccgauugccucaacuguaccgaccuggauguggcccuuggaagaccuaugugcgccggcacaacccccucugcuaaagccagcauucugcaugaaguccggccugugacauccggguguuuucccaucaugcacgaccgcaccaagaucagacaacucccuaaucugcugcggggauaugagaacauucgccucucuacgcagaauguuaucgaugcugaaaaggccccgggcggccccuacagacuggggacaagcggauccugcccuaacgcgaccagcaaaauuggcuucuuugccacaauggcuugggccgugcccaaggacaauuauaaaaacgcuaccaauccucuuaccgucgaggugcccuacaucuguaaggaaggggaggaucagauuacaguguggggauuccauucugacaacaaaacgcagaugaagaaucuguauggcgauuccaacccgcaaaaguuuaccagcucugccaauggggucacaacccacuacguuucccagaucggagacuucccugaucagacagaggacggcggccucccccagagcgggcggauugugguggauuauaugaugcaaaaaccuggaaagaccggcacgaucgucuaccagcgcggggugcugcuuccccagaaaguuuggugcgcgucuggaagauccaaggugaucaaaggcagccugccccucauuggggaagccgacugucugcaugagaaguacggaggccugaacaaauccaagccuuauuacacaggcgaacacgcuaaggccaucgggaacugcccgauuugggucaaaacaccccucaagcuggcuaauggaaccaaauaucggccucccgccaagcugcugaaagagcgcggcuuuuucggggccaucgcuggauuucucgagggcgggugggaaggcaugauugcgggauggcacggcuacacaucucauggggcccacggaguggcuguugccgccgaccuuaagagcacccaggaggcuaucaacaagaucaccaaaaaucuuaacucccugagcgaacucgaggugaagaaucugcaaagacugucuggcgccauggaugaacuccauaacgagauucuggagcuugacgaaaaagucgaugaccugcgggcggauacgaucuccagccagauugagcucgcugugcugcuuucuaaugaagggaucauuaacagcgaggacgaacaucugcucgcccuggagcgcaagcugaaaaagaugcucggaccuuccgccgucgauaucggcaauggguguuucgagaccaagcacaaaugcaaccagacaugccuggacagaaucgcugccggcaccuuuaaugcuggagaguucucucuucccacauuugauagccugaacauuaccgccgcgucccucaaugacgauggccuggacaaccacacgauccugcuuuauuacagcaccgccgcuucuucccucgccgugacacugaugcuggcuauuuucaucguuuauauggugagccgggacaaugucucuuguuccauuugccucuga

SEQ ID NO: 209695 - RNA, 1755 nt, Artificial Sequence; identical to SEQ ID NO: 209691
  derived and/or modified sequence opt5 from hemagglutinin__InfluenzaB__AET10069

SEQ ID NO: 209696 - RNA, 1758 nt, Artificial Sequence
  derived and/or modified sequence opt5 from hemagglutinin__InfluenzaB__AET10070
augaaggccaucauugugcugcucauggucguuaccagcaacgcugacagaaucugcacaggcauuacguccucuaauagcccccacguggugaaaaccgccacacagggggaggucaaggugaccggaguuaucccucugacaaccacaccgaccaaaucccauuucgcgaaccuuaagggcacggaaacccgggggaaacugugucccaagugcccuaauuguacagaucucgacguggcucugggacgccccaagugcaccggcaaaauuccuucugccagagucagcauccuucacgaggugcggcccguuacauccggguguuuuccuaucaugcaugaucgcaccaagauuagacaacugccgaaccuccugcggggauacgaacacauccgccugucuacgcauaaugugauuaacgccgagaaugcucccggcggcccuuauaaaaucgggacaagcggauccugccccaacgucaccaauggcaacggguucuuugccacaauggcuugggccgugccuaagaaugacaaaaacaagaccgcgaccaauccccucacaauugaagugccguacaucuguacggagggagaggaucagauuaccgucuggggcuuccacagcgacaacgaaacacagauggccaagcuguauggggauucuaaaccucagaaguuuaccuccagcgcuaauggaguuacaacccacuacgugucucaaaucggcggcuuccccaaccagacggaggacgggggacuuccucaguccggcagaaucguggucgauuauauggugcagaaaagcgggaagacaggaaccauuaccuaccaacggggcauccugcucccccagaaaguuuggugcgccucugggcgcuccaaggugauuaaaggaagccugccccuuaucggcgaagcugacugucugcaugagaaguauggcgggcucaacaaguccaaaccuuacuacacaggagagcacgccaaggcgauuggcaauugcccgaucugggucaaaacaccccugaagcuggccaacgggacaaaauauagaccucccgcuaagcuccugaaggaacggggauuuuucggcgccaucgcuggguuucuugagggcggaugggaaggcaugauugccggguggcauggauacacgucucacggcgcccacgggguggcuguugcggccgaucugaaaagcacccaggaggcuaucaauaagauuaccaaaaaccucaauucccugagcgaacuugaggugaagaaccugcagcgccucucuggagccauggacgagcugcauaaugaaauccuggagcucgaugaaaaagucgacgaccugagagccgauaccauuuccagccaaaucgagcuugcugugcugcucucuaacgaaggcaucauuaauagcgaggacgagcaucugcuugcccuggaacggaagcucaagaaaaugcuggggccuuccgcggucgagaucggcaacggauguuucgaaacaaagcacaaaugcaaucagaccugccuggaucgcauugcugccggcacguuugacgccggggaguucucucuccccaccuuugauagccugaacaucacagcugccucccuuaaugacgauggacuggacaaccacaccauucuccuguauuacagcacagcugccucuucccuggcggugacccuuaugaucgccauuuucguuguguauauggucagcagagauaaugugucuuguuccaucugccucuga

SEQ ID NO: 209697 - RNA, 1758 nt, Artificial Sequence; identical to SEQ ID NO: 209632
  derived and/or modified sequence opt5 from hemagglutinin__InfluenzaB__AET10071

SEQ ID NO: 209698 - RNA, 1758 nt, Artificial Sequence; identical to SEQ ID NO: 209632
  derived and/or modified sequence opt5 from hemagglutinin__InfluenzaB__AET10072

SEQ ID NO: 209699 - RNA, 1755 nt, Artificial Sequence
  derived and/or modified sequence opt5 from hemagglutinin__InfluenzaB__AET10073
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggaugcgagaacauucgccucucuacacagaaugugaucgaugcugaaaaggccccgggcggccccuauagacuggggaccagcggauccuguccuaacgcuacaagcaaaauuggcuucuuugccaccauggcgugggccguccccaaggacaauuacaaaaacgcuaccaauccucuuacaguggaggugcccuauaucugcaaggaaggggaggaucagauuacggucuggggauuccauucugacaacaaaacccagaugaagaaucuguacggcgauuccaacccgcaaaaguuuacaagcucugccaaugggguuaccacacacuaugugucccagaucggagacuucccugaucagaccgaggacggcggccucccccagagcgggcggauuguggucgauuacaugaugcaaaaaccuggaaagacgggcacaaucguguaucagcgcgggguucugcuuccccagaaaguguggugugcuucuggaagauccaaggucaucaaaggcagccugccccucauuggggaagccgacugccugcaugagaaguacggaggccugaacaaauccaagccuuacuauaccggcgaacacgcgaaggccaucgggaacuguccgauuugggugaaaacaccccucaagcuggcuaauggaaccaaauaccggccucccgccaagcugcugaaagagcgcggcuuuuucggggcuaucgccggauuucucgagggcgggugggaaggcaugauugccggauggcacggcuauaccucucauggggcucacggaguugcgguggccgcugaccuuaagagcacacaggaggccaucaacaagaucacgaaaaaucuuaacucccugagcgaacucgaggucaagaaucugcaaagacugucuggcgccauggaugaacuccauaacgagauucuggagcuugacgaaaaaguggaugaccugcgggcugauaccaucuccagccagauugagcucgccguccugcuuucuaaugaagggaucauuaacagcgaggacgaacaucugcucgcgcuggagcgcaagcugaaaaagaugcucggaccuuccgcuguggauaucggcaaugggugcuucgagacaaagcacaaaugcaaccagaccugucuggacagaaucgccgccggcacauuuaaugcuggagaguucucucuucccaccuuugauagccugaacauuacggccgcuucccucaaugacgauggccuggacaaccacaccauccugcuuuacuauagcacagccgcgucuucccucgccguuacccugaugcuggcuauuuucaucguguacauggucagccgggacaaugugucuugcuccauuugucucuga

SEQ ID NO: 209700 - RNA, 1758 nt, Artificial Sequence
  derived and/or modified sequence opt5 from hemagglutinin__InfluenzaB__AET10074
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgacccggucccauuucgcgaaucuuaagggcacggaaacccgcgggaaacugugucccaagugcccuaacuguacagaucucgacguggcucugggaagacccaaaugcaccggcaagauuccuucugcccgggucagcauccuucacgaggugcgccccguuacauccggguguuuuccuaucaugcaugauagaaccaagauucggcaacugccgaaucuccugcgcggauacgaacacaucagacugucuacgcauaacgugauuaaugccgagaacgcucccggcggcccuuauaaaaucgggacaagcggauccugccccaaugucaccaacggcaauggguucuuugccacaauggcuugggccgugccuaagaacgacaaaaauaagaccgcgaccaacccccucacaauugaagugccguacaucuguacggagggagaggaucagauuaccgucuggggcuuccacagcgacaaugaaacacagauggccaaacuguauggggauucuaagccucagaaguuuaccuccagcgcuaacggaguuacaacccacuacgugucucaaaucggcggcuuccccaaccagacggaggacgggggacuuccucaguccggccggaucguggucgauuauauggugcagaaaagcgggcgcacaggaaccauuaccuaccaaagaggcauccugcucccccagaagguuuggugcgccucugggcgguccaaagugauuaagggaagccugccccuuaucggcgaagcugacugucugcaugagaaauauggcgggcucaauaaguccaaaccuuacuacacaggagagcacgccaaggcgauuggcaacugcccgaucugggucaagacaccccugaaacuggccaaugggaccaaguaucgcccucccgcuaaacuccugaaggaaagaggauuuuucggcgccaucgcuggguuucuugagggcggaugggaaggcaugauugccggguggcauggauacacgucucacggcgcccacgggguggcuguugcggccgaucugaaaagcacccaggaggcuaucaacaagauuacaaagaaucucaacucccugagcgaacuugaggugaaaaaucugcagcggcucucuggagccauggacgagcugcauaacgaaauccuggagcucgaugaaaaggucgacgaccugcgcgccgauaccauuuccagccaaaucgagcuugcugugcugcucucuaaugaaggcaucauuaacagcgaggacgagcaucugcuugcccuggaaagaaaacucaagaaaaugcuggggccuuccgcggucgagaucggcaauggauguuucgaaacaaagcacaagugcaaccagaccugccuggaucggauugcugccggcacguuugacgccggggaguucucucuccccaccuuugauagccugaauaucacagcugccucccuugacgaugacggacuggauaaccacaccauucuccuguauuacagcacagcugccucuucccuggcggugacccuuaugaucgccauuuucguuguguauauggucagcagagacaaugugucuuguuccaucugccucuga

SEQ ID NO: 209701 - RNA, 1758 nt, Artificial Sequence; identical to SEQ ID NO: 209632
  derived and/or modified sequence opt5 from hemagglutinin__InfluenzaB__AET10076

SEQ ID NO: 209702 - RNA, 1758 nt, Artificial Sequence; identical to SEQ ID NO: 209632
  derived and/or modified sequence opt5 from hemagglutinin__InfluenzaB__AET10077

SEQ ID NO: 209703 - RNA, 1758 nt, Artificial Sequence
  derived and/or modified sequence opt5 from hemagglutinin__InfluenzaB__AET10078
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcgugcugcacgagguucggccugugacauccggguguuuucccaucaugcaugaucgcaccaaaaucagacaacucccuaaucugcugcggggauacgaacacauucgccucucuacgcauaacgucaucaaugccgagaacgcuccgggcggccccuauaagauugggacaagcggauccugcccuaaugugaccaacggcaauggguucuuugccacaauggcuugggccgugcccaaaaacgacaagaauaaaaccgcgaccaacccucugacaaucgaaguccccuacauuuguacggagggagaggaucagaucaccguuuggggcuuccacagcgacaaugaaacacagauggccaaacuuuauggggauucuaagccgcagaaguuuaccuccagcgcuaacggagugacaacccacuacgugucucaaauuggcggcuucccuaaccagacggaggacgggggacugccccaguccggcagaaucgucguggauuauaugguucaaaagagcgggaaaacaggaaccaucaccuaccagcggggcauucuccugccucagaagguguggugcgccucugggcgcuccaaagucaucaagggaagccuuccccugauuggcgaagcugacugucuccaugagaaauauggcgggcugaauaaguccaagcccuacuacacaggagagcacgccaaagcgaucggcaacugcccuauuugggugaagaccccgcugaaacucgccaaugggacaaaguauagacccccugcuaaacugcuuaaggaacggggauuuuucggcgccaucgcuggguuucuggagggcggaugggaaggcaugaucgccggguggcauggauacacgucucacggcgcccacgggguugcuguggcggccgaucucaagagcacccaggaggcuauuaacaaaaucacaaagaaucugaacucccuuagcgaacuggaggucaaaaaucuccagcgccugucuggagccauggacgagcugcauaacgaaauucucgagcuggaugaaaagguggacgaccuuagagccgauaccaucuccagccaaauugagcuggcuguccuccugucuaaugaaggcaucaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuuaaugccggggaguucucucugccuaccuuugacagccuuaacauuacagcugccucccugaaugaagauggacucgacaaccacgcuauccugcuguauuacagcaccgccgcgucuucccuugccguuacacucaugauugcuaucuucguggucuauauggugagcagagauaacguuucuuguuccauuugccuguga

SEQ ID NO: 209704 - RNA, 1758 nt, Artificial Sequence
  derived and/or modified sequence opt5 from hemagglutinin__InfluenzaB__AET10079
augaaggccaucauugugcugcucauggucguuaccagcaacgcugacggcaucugcacagggauuacguccucuaauagcccccacguggugaaaaccgccacacagggagaagucaacgugaccggcguuaucccucugacaaccacaccgaccaagucccauuucgcgaaucuuaaagggacggaaaccagaggaaagcugugucccaaaugcccuaacuguacagaucucgacguggcucugggccggcccaagugcaccgggaagauuccuucugcccgcgucagcauccuucacgaggugagacccguuacauccggauguuuuccuaucaugcaugaucggaccaaaauucgccaacugccgaaucuccugagaggcuacgaacacauccggcugucuacgcauaacgugauuaaugccgagaacgcucccggcgggccuuauaagaucggaacaagcggcuccugccccaaugucaccaacgggaauggauucuuuacaaccauggccugggcugugccuaaaaacgacaagaauaaaaccgccacaaacccccucacgauugaagugccguacaucuguaccgagggcgaggaucagauuacagucuggggguuccacagcgacaaugaaacccagauggcgaagcuguauggagauucuaagccucagaaauuuacauccagcgccaacggcguuaccacgcacuacgugucucaaaucggcggguuccccaaccagacagaggacggaggccuuccucaguccgggcgcaucguggucgauuauauggugcaaaagagcggaaaaaccggcaccauuacauaccagagagggauccugcucccccagaagguuuggugcgcuucuggacgguccaaagugauuaagggcagccugccccuuaucggcgaagccgacugucugcaugagaaauaugggggacucaauaaguccaagccuuacuacaccggcgagcacgcuaaagccauugggaacugcccgaucugggucaagacaccccugaaacuggcgaauggaacgaaguaucgcccucccgccaaacuccugaaggaaagaggcuuuuucggggcuaucgccggcuuucuugagggaggcugggaagggaugauugcuggauggcauggcuacaccucucacggggcccacggaguggccguugcugcggaucucaagagcacacaggaggccaucaacaaaauuaccaagaaucugaacucccugagcgaacuugagguggagaaucugcagcggcucucuggcgcuauggacgaacugcauaacgagauccuggaacucgaugagaaagucgacgaccugcgcgccgauacaauuuccagccaaaucgaacuugccgugcugcucucuaaugaggggaucauuaacagcgaggacgaacaucugcuugcucuggagagaaagcucaaaaagaugcugggcccuuccgccgucgaaaucggaaauggcuguuucgagaccaagcacaaaugcaaccagacgugccuggaucggauugcggcugggaccuuugacgccggagaguucucucuccccacauuugauagccugaauaucaccgccgcuucccuuaacgacgauggccuggacaaucacacaauucuccuguauuacagcaccgccgcuucuucccuggccgugacgcuuaugaucgcgauuuucguuguguauauggucagccgcgauaacgugucuuguuccaucugccucuga

SEQ ID NO: 209705 - RNA, 1758 nt, Artificial Sequence; identical to SEQ ID NO: 209632
  derived and/or modified sequence opt5 from hemagglutinin__InfluenzaB__AET10080

SEQ ID NO: 209706 - RNA, 1758 nt, Artificial Sequence; identical to SEQ ID NO: 209632
  derived and/or modified sequence opt5 from hemagglutinin__InfluenzaB__AET10081

SEQ ID NO: 209707 - RNA, 1758 nt, Artificial Sequence
  derived and/or modified sequence opt5 from hemagglutinin__InfluenzaB__AET10082
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacaacccacuacgucucucaaauuggcggcuucccuaaccagacggaggacgggggacugccccaguccggcagaaucguuguggauuauauggugcaaaagagcgggaaaacaggaaccauuaccuaccagcggggcauccuccugccucagaaggucuggugcgccucugggcgcuccaaagugauuaagggaagccuuccccugaucggcgaagcugacugucuccaugagaaauauggcgggcugaauaaguccaagcccuacuacacaggagagcacgccaaagcgaucggcaacugcccuauuuggguuaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcugucgcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaagguugacgaccuuagagccgauaccaucuccagccaaauugagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccaucuucgucguguauaugguuagcagagauaacgugucuuguuccauuugccuguga

SEQ ID NO: 209708 - RNA, 1758 nt, Artificial Sequence
  derived and/or modified sequence opt5 from hemagglutinin__InfluenzaB__AET10083
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagguccccucugccagagugagcauucugcacgagguucggccugugacauccggguguuuucccaucaugcaugaucgcaccaaaaucagacaacucccuaaucugcugcggggauacgaacacauucgccucucuacgcauaacgucaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagcagagauaacgugucuuguuccaucugccuguga

SEQ ID NO: 209709 - RNA, 1758 nt, Artificial Sequence; identical to SEQ ID NO: 209669
  derived and/or modified sequence opt5 from hemagglutinin__InfluenzaB__AET10084

SEQ ID NO: 209710 - RNA, 1758 nt, Artificial Sequence; identical to SEQ ID NO: 209632
  derived and/or modified sequence opt5 from hemagglutinin__InfluenzaB__AET10085

SEQ ID NO: 209711 - RNA, 1758 nt, Artificial Sequence; identical to SEQ ID NO: 209672
  derived and/or modified sequence opt5 from hemagglutinin__InfluenzaB__AET43124

SEQ ID NO: 209712 - RNA, 1758 nt, Artificial Sequence; identical to SEQ ID NO: 209672
  derived and/or modified sequence opt5 from hemagglutinin__InfluenzaB__AET43135

SEQ ID NO: 209713 - RNA, 1758 nt, Artificial Sequence; identical to SEQ ID NO: 209672
  derived and/or modified sequence opt5 from hemagglutinin__InfluenzaB__AET43146

SEQ ID NO: 209714 - RNA, 1758 nt, Artificial Sequence; identical to SEQ ID NO: 209672
  derived and/or modified sequence opt5 from hemagglutinin__InfluenzaB__AET43157

SEQ ID NO: 209715 - RNA, 1758 nt, Artificial Sequence
  derived and/or modified sequence opt5 from hemagglutinin__InfluenzaB__AET43168
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacgugacccuuggacgcccuaagugcacaggcaagauucccucugcuagagucagcauccugcacgaggugcggccuguuaccuccggguguuuucccaucaugcaugaucgcacgaaaauuagacaacucccuaaucugcugcggggauacgaacacauccgccucucuacacauaacgugauuaaugccgagaacgccccgggcggccccuauaagaucgggaccagcggauccugcccuaaugucacaaacggcaauggguucuuugcuaccauggccugggcugugcccaaaaacgacaagaauaaaaccgccacaaacccucugacgauugaagugcccuacaucuguaccgagggagaggaucagauuacagucuggggcuuccacagcgacaaugaaacccagauggcgaaacuuuauggggauucuaagccgcagaaguuuacauccagcgccaacggaguuaccacgcacuacgugucucaaaucggcggcuucccuaaccagacagaggacgggggacugccccaguccggcagaaucguggucgauuauauggugcaaaagagcgggaaaaccggaaccauuacauaccagcggggcauccuccugccucagaagguuuggugcgcuucugggcgcuccaaagugauuaagggaagccuuccccugaucggcgaagccgacugucuccaugagaaauauggcgggcugaauaaguccaagcccuacuacaccggagagcacgcuaaagccauuggcaacugcccuaucugggucaagacaccgcugaaacucgcgaaugggacgaaguauagacccccugccaaacugcuuaaggaacggggauuuuucggcgcuaucgccggguuucuggagggcggaugggaaggcaugauugcuggguggcauggauacaccucucacggcgcccacgggguggccguugcugcggaucucaagagcacacaggaggccaucaacaaaauuaccaagaaucugaacucccuuagcgaacuggaggugaaaaaucuccagcgccugucuggagcuauggacgagcugcauaacgaaauccucgagcuggaugaaaaggucgacgaccuuagagccgauacaauuuccagccaaaucgagcuggccgugcuccugucuaaugaaggcaucauuaacagcgaggacgagcaccuucuggcucucgaacggaaacugaagaagaugcuggggcccuccgccgucgagaucggcaauggauguuucgaaaccaaacauaagugcaaccagacgugccucgaucgcauugcggcuggcaccuuugacgccggggaguucucucugccuacauuugauagccuuaauaucaccgccgcuucccugaacgacgauggacucgacaaucacacaauucugcuguauuacagcaccgccgcuucuucccuugccgugacgcucaugaucgcgauuuucguuguguauauggucagcagagauaacgugucuuguuccaucugccuguga

SEQ ID NO: 209716 - RNA, 1758 nt, Artificial Sequence; identical to SEQ ID NO: 209672
  derived and/or modified sequence opt5 from hemagglutinin__InfluenzaB__AET43179

SEQ ID NO: 209717 - RNA, 1758 nt, Artificial Sequence; identical to SEQ ID NO: 209672
  derived and/or modified sequence opt5 from hemagglutinin__InfluenzaB__AET43190

SEQ ID NO: 209718 - RNA, 1758 nt, Artificial Sequence
  derived and/or modified sequence opt5 from hemagglutinin__InfluenzaB__AET43201
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccggcaacgcuccgggcgggcccuauaagaucggaacaagcggcuccugcccuaaugucaccaacgggaauggauucuuugccacaauggcuugggccgugcccaaaaacgacaagaauaaaaccgcgaccaacccucugacaauugaggugcccuacaucuguacggaaggcgaggaucagauuaccgucuggggguuccacagcgacaaugagacacagauggccaaacuuuauggagauucuaagccgcagaaguuuaccuccagcgcuaacggcguuacaacccacuacgugucucaaaucggcggguucccuaaccagacggaagacggaggccugccccaguccgggagaaucguggucgauuauauggugcaaaagagcggaaaaacaggcaccauuaccuaccagcgggggauccuccugccucagaagguuuggugcgccucuggacgcuccaaagugauuaagggcagccuuccccugaucggcgaggcugacugucuccaugaaaaauaugggggacugaauaaguccaagcccuacuacacaggcgagcacgccaaagcgauugggaacugcccuaucugggucaagaccccgcugaaacucgccaauggaacaaaguauagacccccugcuaaacugcuuaaggagcggggcuuuuucggggccaucgcuggcuuucuggaaggaggcugggaggggaugauugccggauggcauggcuacacgucucacggggcccacggaguggcuguugcggccgaucucaagagcacccaggaagcuaucaacaaaauuacaaagaaucugaacucccuuagcgagcuggaagugaaaaaucuccagcgccugucuggcgccauggacgagcugcauaacgagauccucgaacuggaugagaaggucgacgaccuuagagccgauaccauuuccagccaaaucgaacuggcugugcuccugucuaaugaggggaucauuaacagcgaagacgagcaccuucuggcccucgagcggaaacugaagaagaugcugggccccuccgcggucgaaaucggaaauggcuguuucgagacaaaacauaagugcaaccagaccugccucgaucgcauugcugccgggacguuugacgccggagaguucucucugccuaccuuugauagccuuaauaucacagcugccucccugaacgacgauggccucgacaaucacaccauucugcuguauuacagcacagcugccucuucccuugcggugacccucaugaucgccauuuucguuguguauauggucagcagagauaacgugucuuguuccaucugccuguga

SEQ ID NO: 209719 - RNA, 1758 nt, Artificial Sequence; identical to SEQ ID NO: 209672
  derived and/or modified sequence opt5 from hemagglutinin__InfluenzaB__AET43212

SEQ ID NO: 209720 - RNA, 1758 nt, Artificial Sequence; identical to SEQ ID NO: 209672
  derived and/or modified sequence opt5 from hemagglutinin__InfluenzaB__AET43223

SEQ ID NO: 209721 - RNA, 1758 nt, Artificial Sequence; identical to SEQ ID NO: 209718
  derived and/or modified sequence opt5 from hemagglutinin__InfluenzaB__AET50943

SEQ ID NO: 209722 - RNA, 1758 nt, Artificial Sequence; identical to SEQ ID NO: 209672
  derived and/or modified sequence opt5 from hemagglutinin__InfluenzaB__AET50954

SEQ ID NO: 209723 - RNA, 1758 nt, Artificial Sequence; identical to SEQ ID NO: 209672
  derived and/or modified sequence opt5 from hemagglutinin__InfluenzaB__AET50965

SEQ ID NO: 209724 - RNA, 1758 nt, Artificial Sequence; identical to SEQ ID NO: 209672
  derived and/or modified sequence opt5 from hemagglutinin__InfluenzaB__AET50976

SEQ ID NO: 209725 - RNA, 1758 nt, Artificial Sequence; identical to SEQ ID NO: 209672
  derived and/or modified sequence opt5 from hemagglutinin__InfluenzaB__AET74255

SEQ ID NO: 209726 - RNA, 1758 nt, Artificial Sequence; identical to SEQ ID NO: 209718
  derived and/or modified sequence opt5 from hemagglutinin__InfluenzaB__AET74277

SEQ ID NO: 209727 - RNA, 1758 nt, Artificial Sequence; identical to SEQ ID NO: 209672
  derived and/or modified sequence opt5 from hemagglutinin__InfluenzaB__AET74288

SEQ ID NO: 209728 - RNA, 1758 nt, Artificial Sequence
  derived and/or modified sequence opt5 from hemagglutinin__InfluenzaB__AET74299
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacgugacccuuggacgcccuaagugcacaggcaagauucccucugcuagagucagcauccugcacgaggugcggccuguuaccuccggguguuuucccaucaugcaugaucgcacgaaaauuagacaacucccuaaucugcugcggggauacgaacacauccgccucucuacacauaacgugauuaaugccgagaacgccccgggcggccccuauaagaucgggaccagcggauccugcccuaaugucacaaacggcaauggguucuuugcuaccauggccugggcugugcccaaaaacgacaagaauaaaaccgccacaaacccucugacgauugaagugcccuacaucuguaccgagggagaggaucagauuacagucuggggcuuccacagcgacaaugaaacccagauggcgaagcuguauggggauucuaagccgcagaaauuuacauccagcgccaacggaguuaccacgcacuacgugucucaaaucggcggcuucccuaaccagacagaggacgggggacugccccaguccggcagaaucguggucgauuauauggugcaaaagagcgggaaaaccggaaccauuacauaccagcggggcauccuccugccucagaagguuuggugcgcuucugggcgcuccaaagugauuaagggaagccuuccccugaucggcgaagccgacugucuccaugagaaauauggcgggcugaauaaguccaagcccuacuacaccggagagcacgcuaaagccauuggcaacugcccuaucugggucaagacaccgcugaaacucgcgaaugggacgaaguauagacccccugccaaacugcuuaaggaacggggauuuuucggcgcuaucgccggguuucuggagggcggaugggaaggcaugauugcuggguggcauggauacaccucucacggcgcccacgggguggccguugcugcggaucucaagagcacacaggaggccaucaacaaaauuaccaauaaccuuaauucccuuagcgaacuggaggugaagaaccuccagcgccugucuggagcuauggacgagcugcauaaugaaauccucgagcuggaugaaaaagucgacgaccuuagagccgauacaauuuccagccaaaucgagcuggccgugcuccugucuaacgaaggcaucauuaauagcgaggacgagcaccuucuggcucucgaacggaagcugaaaaagaugcuggggcccuccgccgucgagaucggcaacggauguuucgaaaccaagcauaaaugcaaucagacgugccucgaucgcauugcggcuggcaccuuugacgccggggaguucucucugccuacauuugauagccuuaacaucaccgccgcuucccugaaugacgauggacucgacaaccacacaauucugcuguauuacagcaccgccgcuucuucccuugccgugacgcucaugaucgcgauuuucguuguguauauggucagcagagauaacgugucuuguuccaucugccuguga

SEQ ID NO: 209729 - RNA, 1758 nt, Artificial Sequence; identical to SEQ ID NO: 209672
  derived and/or modified sequence opt5 from hemagglutinin__InfluenzaB__AET74329

SEQ ID NO: 209730 - RNA, 1758 nt, Artificial Sequence; identical to SEQ ID NO: 209672
  derived and/or modified sequence opt5 from hemagglutinin__InfluenzaB__AET74340

SEQ ID NO: 209731 - RNA, 1758 nt, Artificial Sequence; identical to SEQ ID NO: 209672
  derived and/or modified sequence opt5 from hemagglutinin__InfluenzaB__AET74351

SEQ ID NO: 209732 - RNA, 1758 nt, Artificial Sequence; identical to SEQ ID NO: 209669
  derived and/or modified sequence opt5 from hemagglutinin__InfluenzaB__AEY69077

SEQ ID NO: 209733 - RNA, 1758 nt, Artificial Sequence; identical to SEQ ID NO: 209669
  derived and/or modified sequence opt5 from hemagglutinin__InfluenzaB__AFB77676

SEQ ID NO: 209734 - RNA, 1758 nt, Artificial Sequence
  derived and/or modified sequence opt5 from hemagglutinin__InfluenzaB__AFB77677
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcuuuaacuguacagaucucgacguggcucugggacgcccuaagugcaccggcaagauucccucugccagagucagcauccuucacgaggugcggccuguuacauccggguguuuccccaucaugcaugaucgcaccaaaauuagacaacugccuaaucuccugcggggauacgaacacauccgccugucuacgcauaacgugauuaaugccgagaacgcuccgggcggccccuauaagaucgggacaagcggauccugcccuaaugucaccaacggcaauggguuuuucgccacaauggcuugggccgugcccaaaaacgacaagaauaaaaccgcgaccaacccucucacaauugaagugcccuacaucuguacggagggagaggaucagauuaccgucuggggcuuucacagcgacaaugaaacacagauggccaagcuguauggggauucuaagccgcagaaauucaccuccagcgcuaacggaguuacaacccacuacgugucucaaaucggcggcuuuccuaaccagacggaggacgggggacuuccccaguccggcagaaucguggucgauuauauggugcaaaagagcgggaaaacaggaaccauuaccuaccagcggggcauccugcucccucagaagguuuggugcgccucugggcgcuccaaagugauuaagggaagccugccccuuaucggcgaagcugacugucugcaugagaaauauggcgggcucaauaaguccaagcccuacuacacaggagagcacgccaaagcgauuggcaacugcccuaucugggucaagaccccgcugaaacuggccaaugggacaaaguauagacccccugcuaaacuccugaaggaacggggauucuuuggcgccaucgcuggguuccuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggcccuccgcggucgagaucggcaauggauguuuugaaacaaaacacaagugcaaccagaccugccuggaucgcauugcugccggcacguucgacgccggggaguuuucucucccuaccuucgauagccugaauaucacagcugccucccuuaacgacgauggacuggacaaucacaccauucuccuguauuacagcacagcugccucuucccuggcggugacccuuaugaucgccauuuucguuguguauauggucagcagagauaacgugucuuguuccaucugccucuga

SEQ ID NO: 209735 - RNA, 1758 nt, Artificial Sequence; identical to SEQ ID NO: 209669
  derived and/or modified sequence opt5 from hemagglutinin__InfluenzaB__AFB77678

SEQ ID NO: 209736 - RNA, 1758 nt, Artificial Sequence; identical to SEQ ID NO: 209669
  derived and/or modified sequence opt5 from hemagglutinin__InfluenzaB__AFB77679

SEQ ID NO: 209737 - RNA, 1758 nt, Artificial Sequence
  derived and/or modified sequence opt5 from hemagglutinin__InfluenzaB__AFB77680
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuaucacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaaugugaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugauugccaucuucgugguuuauauggugagcagagauaacgucucuuguuccaucugccuguga

SEQ ID NO: 209738 - RNA, 1758 nt, Artificial Sequence; identical to SEQ ID NO: 209669
  derived and/or modified sequence opt5 from hemagglutinin__InfluenzaB__AFB77681

SEQ ID NO: 209739 - RNA, 1758 nt, Artificial Sequence
  derived and/or modified sequence opt5 from hemagglutinin__InfluenzaB__AFB77682
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacacagaaucugaacucccuuagcgaacuggagguuaagaaucuccaacgccugucuggagccauggacgagcugcauaacgaaauucucgagcuggaugaaaaaguggacgaccuuagagccgauaccaucuccagccagaucgagcuggcuguccuccugucuaaugaaggcauuaucaacagcgaggacgagcaccuucuggcccucgaacggaagcugaaaaagaugcuggggcccuccgcgguggagauuggcaauggauguuucgaaacaaagcauaaaugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugauugccaucuucgugguuuauauggugagcagagauaacgucucuuguuccaucugccuguga

SEQ ID NO: 209740 - RNA, 1758 nt, Artificial Sequence; identical to SEQ ID NO: 209669
  derived and/or modified sequence opt5 from hemagglutinin__InfluenzaB__AFB77683

SEQ ID NO: 209741 - RNA, 1758 nt, Artificial Sequence; identical to SEQ ID NO: 209669
  derived and/or modified sequence opt5 from hemagglutinin__InfluenzaB__AFB77684

SEQ ID NO: 209742 - RNA, 1758 nt, Artificial Sequence
  derived and/or modified sequence opt5 from hemagglutinin__InfluenzaB__AFB77685
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagacacccucugccagagucagcauucugcacgaggugcggccuguuaccuccggguguuuucccaucaugcaugaucgcacgaaaaucagacaacucccuaaucugcugcggggauacgaacacauucgccucucuacacauaacgugaucaaugccgagaacgcuccgggcggccccuauaagauugggaccagcggauccugcccuaauaucacaaacggcaauggguucuuugccaccauggcuugggccguccccaaaaacgacaagaauaaaaccgcgacaaacccucugacgauugaagugcccuacaucuguaccgagggagaggaucagauuacaguguggggcuuccacagcgacaaugaaacccagauggccaaacuuuauggggauucuaagccgcagaaauuuacauccagcgcuaacggagucaccacgcacuacaucucucaaaucggcggcuucccuaaccagacagaggacgggggacugccccaguccggcagaauuguuguggauuauauggugcaaaagagcgaaaagaccgggaccaucacauaccagcggggcauucuccugccucagaaggucuggugcgccucuggacgcuccaaagugaucaaggggagccuuccccugauuggagaggcugacugucuccaugagaaauauggcggccugaauaaguccaagcccuacuacaccggggaacacgccaaagcgaucggaaacugcccuaucuggguuaagacaccgcugaaacucgccaauggcacgaaguauagacccccugcuaaacugcuuaaggagcggggguuuuucggagccauugcuggcuuucuggaagggggcugggagggaaugaucgccggcuggcauggguacaccucucacggagcccacggcguggcugucgcggccgaucucaagagcacacaggaagcuauuaacaaaaucaccaagaaucugaacucccuuagcgagcuggaggugaaaaaucuccagcgccugucuggggccauggacgaacugcauaacgagauucucgaacuggaugagaagguugacgaccuuagagccgauacaaucuccagccaaaucgaacuggcugugcuccugucuaaugagggaauuaucaacagcgaggacgaacaccuucuggcccucgagcggaaacugaagaagaugcugggccccuccgcggucgaaauugggaauggcuguuucgagaccaaacauaagugcaaccagacgugccucgaucgcaucgcugccggaaccuuugacgccggcgaguucucucugccuacauuugauagccuuaauauuaccgcugccucccugaacgacgaugggcucgacaaucacacaauccugcuguauuacagcaccgcugccucuucccuugcggugacgcucaugauugccaucuucgucguguauaugguuagcagagauaacgugucuuguuccaucugccuguga

SEQ ID NO: 209743 - RNA, 1758 nt, Artificial Sequence
  derived and/or modified sequence opt5 from hemagglutinin__InfluenzaB__AFB77686
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucuccggcuucccuaaccagacggaggacggcgggcugccccagagcggaagaauugugguggauuauaugguccagaagucuggcaaaacagggaccaucaccuaccaacgggggauucuccugccucagaagguguggugcgccuccggccgcagcaaaguuaucaaggggucccuuccccugauuggagaagcugacugucuccaugagaaauauggcggccugaauaagucuaagcccuacuacacaggggagcacgccaaagcgaucggaaacugcccuaucugggugaagaccccgcugaaacucgccaauggcacaaaguauagacccccugcuaaacugcuuaaggaacggggguuuuucggagccauugcuggcuuucuggagggaggcugggaaggaaugaucgccggcuggcauggguacacgagccacggagcccacggcgucgcuguggcggccgaucucaaguccacccaggaggcuauuaacaaaaucacacagaaucugaacagccuuucugaacuggagguuaagaaucuccaacgccuguccggggccauggacgagcugcauaacgaaauucucgagcuggaugaaaaaguggacgaccuuagagccgauaccaucagcucucagaucgagcuggcuguccuccugagcaaugaaggaauuaucaacuccgaggacgagcaccuucuggcccucgaacggaagcugaaaaagaugcugggccccucugcgguggagauugggaauggcuguuucgaaacaaagcauaaaugcaaccagaccugccucgaucgcaucgcugccggaacguuugacgccggcgaguucagccugccuaccuuugauucccuuaauauuacagcugccagccugaacgacgaugggcucgacaaucacaccauccugcuguauuacucuacagcugccuccagccuugcggucacccucaugauugccaucuucgugguuuauauggugucuagagauaacgucuccuguagcaucugccuguga

SEQ ID NO: 209744 - RNA, 1758 nt, Artificial Sequence
  derived and/or modified sequence opt5 from hemagglutinin__InfluenzaB__AFB77687
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacaucaagcucucuacgcauaacgugauuaaugccgagaacgcuccgggcggccccuauaaaaucgggacaagcggauccugcccuaaugucaccaacggcaauggguucuuugccacaauggcuugggccgugcccaagaacgacaaaaauaagaccgcgaccaacccucugacaauugaagugcccuacaucuguacggagggagaggaucagauuaccgucuggggcuuccacagcgacaaugaaacacagauggccaaacuuuauggggauucuaaaccgcagaaguuuaccuccagcgcuaacggaguuacaacccacuacgugucucaaaucggcggcuucccuaaccagacggaggacgggggacugccccaguccggccgcaucguggucgauuauauggugcagaaaagcgggaagacaggaaccauuaccuaccaaagaggcauccuccugccucagaaaguuuggugcgccucugggcgguccaaggugauuaaaggaagccuuccccugaucggcgaagcugacugucuccaugagaaguauggcgggcugaauaaguccaaacccuacuacacaggagagcacgccaaggcgauuggcaacugcccuaucugggucaaaaccccgcugaagcucgccaaugggacaaaauauagacccccugcuaagcugcuuaaggaacgcggauuuuucggcgccaucgcuggguuucuggagggcggaugggaaggcaugauugccggguggcauggauacacgucucacggcgcccacgggguggcuguugcggccgaucucaaaagcacccaggaggcuaucaacaagauuacaaagaaucugaacucccuuagcgaacuggaggugaagaaucuccagcggcugucuggagccauggacgagcugcauaacgaaauccucgagcuggaugaaaaagucgacgaccuucgcgccgauaccauuuccagccaaaucgagcuggcugugcuccugucuaaugaaggcaucauuaacagcgaggacgagcaccuucuggcccucgaaagaaagcugaagaaaaugcuggggcccuccgcggucgagaucggcaauggauguuucgaaacaaagcauaaaugcaaccagaccugccucgaucggauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagccgcgauaacgugucuuguuccaucugccuguga

SEQ ID NO: 209745 - RNA, 1758 nt, Artificial Sequence
  derived and/or modified sequence opt5 from hemagglutinin__InfluenzaB__AFB77688
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaaggccccgcugaaacucgcuaaugggaccaaguauagacccccugccaaacugcuuaaggaacggggauuuuucggcgcuaucgccggguuucuggagggcggaugggaaggcaugauugccggguggcauggauacacaucucacggcgcucacgggguggcgguugccgcugaucucaagagcacgcaggaggccaucaacaaaauuaccaagaaucugaacucccuuagcgaacuggaggugaaaaaucuccagcgccugucuggagccauggacgagcugcauaacgaaauccucgagcuggaugaaaaggucgacgaccuuagagcugauacaauuuccagccaaaucgagcuggccgugcuccugucuaaugaaggcaucauuaacagcgaggacgagcaccuucuggcgcucgaacggaaacugaagaagaugcuggggcccuccgcugucgagaucggcaauggauguuucgaaaccaaacauaagugcaaccagacaugccucgaucgcauugccgccggcaccuuugacgcuggggaguucucucugccuacguuugauagccuuaauaucaccgccgcuucccugaacgacgauggacucgacaaucacacaauucugcuguauuacagcaccgccgcgucuucccuugccgugacacucaugaucgcuauuuucguuguguauauggucagcagagauaacgugucuuguuccaucugccuguga

SEQ ID NO: 209746 - RNA, 1758 nt, Artificial Sequence; identical to SEQ ID NO: 209669
  derived and/or modified sequence opt5 from hemagglutinin__InfluenzaB__AFB77689

SEQ ID NO: 209747 - RNA, 1758 nt, Artificial Sequence; identical to SEQ ID NO: 209669
  derived and/or modified sequence opt5 from hemagglutinin__InfluenzaB__AFB77690

SEQ ID NO: 209748 - RNA, 1758 nt, Artificial Sequence; identical to SEQ ID NO: 209707
  derived and/or modified sequence opt5 from hemagglutinin__InfluenzaB__AFE00360

SEQ ID NO: 209749 - RNA, 1758 nt, Artificial Sequence; identical to SEQ ID NO: 209707
  derived and/or modified sequence opt5 from hemagglutinin__InfluenzaB__AFF18534

SEQ ID NO: 209750 - RNA, 1758 nt, Artificial Sequence; identical to SEQ ID NO: 209707
  derived and/or modified sequence opt5 from hemagglutinin__InfluenzaB__AFF18543

SEQ ID NO: 209751 - RNA, 1758 nt, Artificial Sequence; identical to SEQ ID NO: 209669
  derived and/or modified sequence opt5 from hemagglutinin__InfluenzaB__AFG48978

SEQ ID NO: 209752 - RNA, 1758 nt, Artificial Sequence; identical to SEQ ID NO: 209669
  derived and/or modified sequence opt5 from hemagglutinin__InfluenzaB__AFG48997

SEQ ID NO: 209753 - RNA, 1758 nt, Artificial Sequence
  derived and/or modified sequence opt5 from hemagglutinin__InfluenzaB__AFG48998
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugaaacaauggccugggcugugccuaaaaacgacaagaauaaaaccgccaccaacccccucacaauugaggugccguacaucuguacggagggagaagaucagauuaccgucuggggcuuccacagcgacaaugagacacagauggcgaagcuguauggggauucuaagccucagaaauuuaccuccagcgccaacggaguuacaacccacuacgugucucaaaucggcggcuuccccaaccagacggaagacgggggacuuccucaguccggcagaaucguggucgauuauauggugcaaaagagcgggaaaacaggaaccauuaccuaccagcggggcauccugcucccccagaagguuuggugcgcuucugggcgcuccaaagugauuaagggaagccugccccuuaucggcgaggccgacugucugcaugagaaauauggcgggcucaauaaguccaagccuuacuacacaggagaacacgcuaaagccauuggcaacugcccgaucugggucaagacaccccugaaacuggcgaaugggaccaaguauagaccucccgccaaacuccugaaggagcggggauuuuucggcgcuaucgccggguuucuugaaggcggaugggagggcaugauugcuggguggcauggauacacgucucacggcgcccacgggguggccguugcugcggaucucaagagcacccaggaagccaucaacaaaauuacaaagaaucugaacucccugagcgagcuugaggugaaaaaucugcagcgccucucuggagcuauggacgaacugcauaacgagauccuggaacucgaugagaaggucgacgaccugagagccgauaccauuuccagccaaaucgaacuugccgugcugcucucuaaugagggcaucauuaacagcgaggacgaacaucugcuugcucuggagcggaaacucaagaagaugcuggggccuuccgccgucgaaaucggcaauggauguuucgagacaaaacacaagugcaaccagaccugccuggaucgcauugcggcuggcacguuugacgccggggaguucucucuccccaccuuugauagccugaauaucacagccgcuucccuuaacgacgauggacuggacaaucacaccauucuccuguauuacagcacagccgcuucuucccuggccgugacccuuaugaucgcgauuuucguuguguauauggucagcagagauaacgugucuuguuccaucugccucuga

SEQ ID NO: 209754 - RNA, 1755 nt, Artificial Sequence
  derived and/or modified sequence opt5 from hemagglutinin__InfluenzaB__AFG49012
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucccuaaucugcugagaggauaugagaacauucggcucucuacacagaaugugaucgaugcugaaaaagccccgggcggccccuaccgccuggggaccagcggauccugcccuaacgcuacaagcaagauuggcuucuuugccaccauggcgugggccguccccaaagacaauuauaagaacgcuaccaauccucuuacaguggaggugcccuacaucuguacggaaggggaggaucagauuaccgucuggggauuccauucugacaacaaaacacagaugaagaaucuguauggcgauuccaacccgcaaaaguuuaccagcucugccaaugggguuacaacccacuacgugucccagaucggagacuucccugaucagacggaggacggcggccucccccagagcgggagaauuguggucgauuauaugaugcaaaaaccuggaaagacaggcaccaucguguaccagcgcgggguucugcuuccccagaaaguguggugcgcuucuggacgguccaaggucaucaaaggcagccugccccucauuggggaagccgacugucugcaugagaaguacggaggccugaacaaauccaagccuuauuacaccggcgaacacgcgaaggccaucgggaacugcccgauuugggugaaaacaccccucaagcuggcuaauggaaccaaauauagaccucccgccaagcugcugaaagagcggggcuuuuucggggcuaucgccucuuuucucgagggaggcugggaagggaugauugccggcuggcacggauacacaagccauggcgcucacgggguugcgguggccgcugaccugaaguccacgcaggaggccaucaacaagaucaccaaaaaucuuaacagccugucugaacucgaggucaagaaucugcaacgccuguccggagccauggaugaacuccauaacgagauucuggagcuugacgaaaaaguggaugaccugagagcugauacaaucagcucucagauugagcucgccguccugcuuagcaaugaaggcaucauuaacuccgaggacgaacaccuucucgcgcuggagcggaagcugaaaaagaugcucgggccuucugcuguggauaucggaaauggcuguuucgagaccaagcacaaaugcaaccagacaugccuggaccgcaucgccgccgggaccuuuaaugcuggcgaguucagccuucccacguuugauucccugaacauuaccgccgcuagccucaaugacgauggacuggacaaccauacaauccugcuuuauuacucuaccgccgcguccagccucgccguuacacugaugcuggcuauuuucaucguguauauggucucuagagacaauguguccuguagcauuugccucuga

SEQ ID NO: 209755 - RNA, 1755 nt, Artificial Sequence
  derived and/or modified sequence opt5 from hemagglutinin__InfluenzaB__AFG49013
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuuguacggaaggggaggaucagaucaccgucuggggauuccauuccgacaauaaaacacagaugaagaaccuguacggcgauagcaauccccaaaaguuuaccucuuccgcuaacgggguuacaacccacuaugugagccagauuggaggcuucccggaccagacggaggauggcgggcucccucagucuggaagaaucguggucgacuacaugaugcaaaaacccggcaagacagggaccauuguguaucagcggggaguucugcuuccucagaaaguguggugcgccuccggccgcagcaaggucaucaaagggucccugccccucaucggagaagcggauugucugcaugagaaguacggcggccugaacaaaucuaagcccuacuauaccggggaacacgccaaggcuauuggaaauugcccuaucugggugaaaacaccgcucaagcuggccaacggcaccaaauacagacccccugcuaagcugcugaaagagcggggguuuuucggagccauugccggcuuucucgaagggggcugggaaggaaugaucgcuggcuggcacggguauacaagccauggagcgcacggcguugccguggcugccgaccugaaguccacgcaggaggccauuaauaagaucaccaaaaaccuuaauagccugucugaacucgaggucaagaaccugcaacgccuguccggggcuauggacgaacuccauaaugagauccuggagcuugaugaaaaaguggacgaucugagagccgacacaauuagcucucagaucgagcucgcgguccugcuuagcaacgaaggaauuaucaauuccgaggaugaacaccuucucgcucuggagcggaagcugaaaaagaugcucggccccucugccguggacauugggaacggcuguuucgagaccaagcacaaaugcaaucagacaugccuggaucgcaucgccgcuggaaccuuuaacgccggcgaguucagccuuccuacguuugacucccugaauaucaccgcugccagccucaacgaugacgggcuggauaaucauacaauucugcuuuacuauucuaccgcggccuccagccucgcuguuacacugaugcuggccaucuucauuguguacauggucucuagagacaacguguccuguagcaucugccucuga

SEQ ID NO: 209756 - RNA, 1755 nt, Artificial Sequence
  derived and/or modified sequence opt5 from hemagglutinin__InfluenzaB__AFH57865
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacaccgaugaaaaaccuguacggcgauagcaauccucagaaguuuaccucuuccgccaacgggguuacaacccacuaugugagccaaauuggaggcuuccccgaccagacggaggauggcgggcucccucagucuggacggaucguggucgacuacaugaugcagaagcccggcaaaacagggaccauuguguaucaacgcggaguucugcuuccccagaagguguggugcgcuuccggcagaagcaaagucaucaaggggucccugccucucaucggagaagccgauugucugcaugagaaauacggcggccugaacaagucuaaaccguacuauaccggggaacacgcgaaggccauuggaaauugccccaucugggugaagacaccucucaaacuggcuaacggcaccaaguaccggcccccugccaaacuucugaaggagcgcggguuuuucggagcuauugccggcuuucucgaagggggcugggaaggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcagagacuguccggggccauggacgaacuccauaaugagauccuggagcuugaugaaaagguggacgaucugcgggcugacacaauuagcucucaaaucgagcucgccguccugcuuagcaacgaaggaauuaucaauuccgaggaugaacaucugcucgcgcuggagcgcaaacugaagaaaaugcucggccccucugcuguggacauugggaacggcuguuucgagaccaagcacaagugcaaucagacaugccuggauagaaucgccgccggaaccuuuaacgcuggcgaguucagccuuccgacguuugacucccugaauaucaccgccgcuagccucaacgaugacgggcuggauaaucacacaauucugcuuuacuauucuaccgccgcguccagccucgccguuacacugaugcuggcuaucuucauuguguacauggucucucgggacaacguguccuguagcaucugccucuga

SEQ ID NO: 209757 - RNA, 1755 nt, Artificial Sequence
  derived and/or modified sequence opt5 from hemagglutinin__InfluenzaB__AFH57876
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagaaccagaugaaaaaucuguacggcgauagcaacccgcaaaaguuuacaucuuccgccaacgggguuaccacacacuaugugagccagauuggaucuuucccugaccagaccgaggauggcggccucccccaguccgggcggaucguggucgacuacaugaugcaaaagccuggaaaaacgggcacaauuguguaucagcgcgggauccugcuuccccagaagguuuggugcgcuagcggaagauccaaagugaucaagggcucucugccccucauuggggaagccgauugucugcaugagaaauacggaggccugaauaagagcaaaccuuacuauaccggcgaacacgcgaaggccaucgggaacugcccgauuugggucaagacaccccucaaacuggcuaauggaaccaaguaccggccucccgccaaacuucugaaggagcgcggcuuuuucggggcuaucgccggauuucucgagggcgggugggaaggcaugauugccggauggcacggcuauaccucccauggggcucacggaguggcgguugccgcugaccugaaaagcacacaggaggccaucaacaagaucacgaagaaucuuaacucucuguccgaacucgaggugaaaaaucugcaaagacugagcggcgccauggacgaacuccauaacgagauucuggagcuugaugaaaaggucgacgaucugcgggcugacaccaucucuagccagauugagcucgccgugcugcuuuccaaugaagggaucauuaacucugaggaugaacaucugcucgcgcuggagcgcaaacugaagaaaaugcucggaccuagcgcugucgagaucggcaauggguguuucgaaacaaagcacaagugcaaccagaccugccuggacagaaucgccgccggcacauuuaaugcuggagaguucucccuucccaccuuugauagccugaacauuacggccgcuucucucaaugacgauggccuggacaaccacaccauccugcuuuacuauuccacagccgcgagcucucucgccgugacccugaugcuggcuauuuucaucguuuacauggugucccgggauaacgucagcuguuccauuugccucuga

SEQ ID NO: 209758 - RNA, 1755 nt, Artificial Sequence
  derived and/or modified sequence opt5 from hemagglutinin__InfluenzaB__AFH57942
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagaaucagaugaaaucccuguauggcgauagcaacccgcaaaaguuuacaucuuccgccaaugggguuaccacacacuacgugagccagaucggagacuucccugaucagaccgaggacggcggccucccccagucugggcggauuguggucgauuauaugaugcaaaagccuggaaaaacgggcacaaucguguaccagcgcgggguucugcuuccccagaagguguggugcgcuuccggaagaagcaaagucaucaagggcucccugccccucauuggggaagccgacugucugcaugagaaauacggaggccugaacaagucuaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacaccagccauggggcucacggaguugcgguggccgcugaccugaaauccacacaggaggccaucaacaagaucacgaagaaucuuaacagccugucugaacucgaggucaaaaaucugcaaagacuguccggcgccauggaugaacuccauaacgagauucuggagcuugacgaaaagguggaugaccugcgggcugauaccaucagcucucagauugagcucgccguccugcuuagcaaugaagggaucauuaacuccgaggacgaacaucugcucgcgcuggagcgcaaacugaagaaaaugcucggaccuucugcuguggauaucggcaauggguguuucgagacaaagcacaagugcaaccagaccugccuggacagaaucgccgccggcacauuuaaugcuggagaguucagccuucccaccuuugauucccugaacauuacggccgcuagccucaaugacgauggccuggacaaccacaccauccugcuuuauuacucuacagccgcguccagccucgccguuacccugaugcuggcuauuuucaucguguauauggucucucgggacaauguguccuguagcauuugccucuga

SEQ ID NO: 209759 - RNA, 1752 nt, Artificial Sequence
  derived and/or modified sequence opt5 from hemagglutinin__InfluenzaB__AFH57986
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaacgcgccccgggcggccccuauagacuggggaccagcggauccugcccuaacgucacaagccgggacggcuucuuugcuaccauggccugggcggugccccgcgauaauaaaaccgccacaaacccucuuacgguggagguccccuacauuuguaccaagggggaagaccagaucacaguuuggggauuccacucugaugacaaaacccagaugaagaaucuguauggcgauuccaacccgcaaaaauuuacaagcucugcuaauggggugaccacgcauuacgugucccagauuggaggcuucccuaaccagacagaggacggcgggcucccccagagcggaagaaucgucguggauuauaugguucaaaagccuggcaagaccgggaccauuguguaccagcggggaguccugcuuccccagaaaguguggugcgccucuggccgcuccaagguuaucaaagggagccugccccucaucggagaggcugacugucugcacgaaaaguauggcggccugaacaaauccaagccuuacuacacaggggagcacgccaaagcgauuggaaauugcccgaucugggugaagacaccccucaagcuggccaacggcaccaaauauagaccucccgcuaagcugcugaaagaacggggguuuuucggagccauugcuggcuuucucgaagggggcugggagggaaugaucgccggcuggcauggguacacgucucacggagcccauggcgucgcuguggcggccgaucuuaagagcacccaggaggcuauuaauaaaaucacaaagaaccuuaauucccugagcgagcucgaagucaagaaccugcaacgccugucuggggccauggacgagcuccacaaugaaauccuggagcuugacgagaaaguggaugaccugagagccgauaccauuuccagccagaucgaacucgcuguucugcuuucuaacgagggaauuaucaauagcgaagacgagcaucugcucgcccuggaacggaagcugaaaaagaugcucggcccuuccgcgguggauauugggaacggcuguuucgagacaaaacacaagugcaaucagaccugccuggacagaaucgcugccggaacguuuaacgccggcgaguucucucuucccaccuuugauagccugaauaucacagcugccucccucaacgacgaugggcuggacaaucacaccauucugcuuuauuacagcacagcugccucuucccucgcggucacccugaugaucgccauuuucaucguguauaugguuagccgcgauaacgugucuuguuccauuugccuguga

SEQ ID NO: 209760 - RNA, 1758 nt, Artificial Sequence
  derived and/or modified sequence opt5 from hemagglutinin__InfluenzaB__AFH58249
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccccugccaaagucucuauccugcacgaagugagacccguuacaagcggguguuuuccuaucaugcaugaucggaccaagauucgccaacucccgaaccugcugagaggauacgagcggauccgccucuccaaucacaacgugauuaaugccgaagaggcucccggcggcccuuauaaaaucgggacgucuggaagcugccccaacgucacaaauggcaacggguucuuugccaccauggcuugggccgugccuaagaaugaaaacaauaaaacagcgaccaacucccugaccauugaggugcccuacaucuguacagagggagaagaccagauuacggucuggggcuuccauagcgauucugagacccagauggccaaacuuuauggggacuccaagccgcagaaauuuacaagcucugcuaacggaguuaccacacacuacgugucccaaaucggcggcuucccuaaucagaccgaagaugggggacugccccagagcggcagaaucguggucgacuauauggugcagaagucugggaaaacgggaacaauuaccuaccaacggggcauccuccugccucagaagguuuggugcgccuccgggcgcagcaaagugauuaagggaucccuuccccugaucggcgaggcugauugucuccacgagaaauauggcgggcugaacaagucuaagcccuacuacaccggagaacaugccaaagcgauuggcaauugcccuaucugggucaagacaccgcugaaacucgccaacgggaccaaguauagacccccugcuacacugcuuaaagagcggggauuuuucggcgccaucgcuggguuucuggaaggcggaugggagggcaugauugccggguggcacggauacacgagccauggcgcccacgggguggcuguugcggccgaccucaaguccacccaggaagcuaucaauaagauuacaaagaaccugaauagccuuucugagcuggaggugaagaaccuccagcgccuguccggagccauggaugaacugcacaaugagauccucgaacuggacgagaaagucgaugaccuuagagccgacaccauuagcucucaaaucgaacuggcugugcuccugagcaacgagggcaucauuaauuccgaggaugaacaucuucuggcccucgagcggaagcugaaaaagaugcuggggcccucugcggucgaaaucggcaacggauguuucgagacaaagcacaaaugcaaucagaccugccucgaccgcauugcugccggcacguuuaacgccggggaguucagccugccuaccuuugauucccuuaauaucacagcugccagccugaacgacgauggacucgacaaccauaccauucugcuguauuacucuacagcugccuccagccuugcggugacccucaugaucgccauuuucguuguguauauggucucuagagauaauguguccuguagcaucugccuguga

SEQ ID NO: 209761 - RNA, 1758 nt, Artificial Sequence
  derived and/or modified sequence opt5 from hemagglutinin__InfluenzaB__AFH58260
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaauccagauggccaagcuguauggggauuccaagccccagaaauuuacaucuagcuccaacggaguuaccacacacuacgugagccaaaucggcggcuucccgaaucagaccgaggacgggggacugccucagucuggccgcauuguggucgauuauauggugcagaaguccgggaaaacgggaacaaucaccuaccaaagaggcauucuccugccccagaagguuuggugcgcuagcgggcgguccaaagugaucaagggaucucuuccucugauuggcgaagccgacugucuccaugagcgcuauggcgggcugaacaaaagcaagcccuacuacaccggagagcacgcuaaggccaucggcaauugccccaucugggucaaaacaccucugaagcucgcgaacgggaccaaauauagaccgcccgccaagcugcuuaaagaacggggauuuuucggcgcuauugccggguuucuggagggcggaugggaaggcaugaucgcuggguggcauggauacacaucccacggcgcccacgggguggccguugcugcggaucucaagagcacgcaggaggccauuaauaagaucaccaaaaaccuuaauucucuuuccgaacuggaggugaagaaccuccagcgccugagcggagcuauggacgagcugcauaaugaaauucucgagcuggaugaaaaagucgacgaccuuagagccgauacaaucucuagccaaaucgagcuggccgugcuccuguccaacgaaggcauuaucaauucugaggacgagcaccuucuggcucucgaacggaagcugaaaaagaugcuggggccuagcgccgucgagauuggcaacggauguuucgaaaccaagcauaaaugcaaucagacaugccucgaucgcaucgcggcuggcaccuuugacgccggggaguucucccugcccacguuugauagccuuaacauuaccgccgcuucucugaaugacgauggacucgacaaccacacaauccugcuguauuacuccaccgccgcuagcucucuugccgugacacucaugauugcgaucuucguuguguauauggucuccagagauaacgugagcuguuccaucugccuguga

SEQ ID NO: 209762 - RNA, 1755 nt, Artificial Sequence
  derived and/or modified sequence opt5 from hemagglutinin__InfluenzaB__AFH58271
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugaagccuguuaccuccggguguuuucccaucaugcacgaccggacgaagauccgccaacucccuaaucugcugagaggauaugagaacauucggcucucuacacagaaugugaucgaugcugaaaaagccccgggcggccccuaccgccuggggaccagcggauccugcccuaacgcuacaagcaagucuggcuucuuugccaccauggcgugggccguccccaaagacaauaacaagaaugcuaccaacccucuuacaguggaggugcccuauauuuguacggaaggggaggaucagaucaccgucuggggauuccauuccgacgauaaaacacagaugaagaaucuguacggcgacagcaacccgcaaaaguuuaccucuuccgccaaugggguuacaacccacuaugugagccagauuggaucuuucccugaucagacggaggacggcggccucccccaguccgggagaaucguggucgauuacaugaugcaaaaaccuggaaagacaggcaccauuguguaucagcgcgggguucugcuuccccagaaaguguggugcgcuagcggacgguccaaggucaucaaaggcucucugccccucaucggggaagccgacugucugcaugagaaguacggaggccugaacaaaagcaagccuuacuauaccggcgaacacgcgaaggccauugggaacugcccgaucugggugaaaacaccccucaagcuggcuaauggaaccaaauacagaccucccgccaagcugcugaaagagcggggcuuuuucggggcuauugccggauuucucgagggcgggugggaaggcaugaucgccggauggcacggcuauacaucccauggggcucacggaguugcgguggccgcugaccuuaagagcacgcaggaggccauuaacaagaucaccaaaaaucuuaacucucuguccgaacucgaggucaagaaucugcaacgccugagcggcgccauggaugaacuccauaacgagauccuggagcuugacgaaaaaguggaugaccugagagcugauacaauuucuagccagaucgagcucgccguccugcuuuccaaugaagggauuaucaacucugaggacgaacaucugcucgcgcuggagcggaagcugaaaaagaugcucggaccuagcgcuguggagauuggcaauggguguuucgaaaccaagcacaaaugcaaccagacaugccuggaucgcaucgccgccggcaccuuuaaugcuggagaguucucccuucccacguuugacagccugaacaucaccgccgcuucucucaaugaugacggccuggauaaccacacaauucugcuuuacuauuccaccgccgcgagcucucucgccguuacacugaugcuggcuaucuucauuguguacauggucuccagagacaaugugagcuguuccaucugccucuga

SEQ ID NO: 209763 - RNA, 1755 nt, Artificial Sequence; identical to SEQ ID NO: 209762
  derived and/or modified sequence opt5 from hemagglutinin__InfluenzaB__AFH58282

SEQ ID NO: 209764 - RNA, 1758 nt, Artificial Sequence
  derived and/or modified sequence opt5 from hemagglutinin__InfluenzaB__AFH58293
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacgaugaaacacagauggccaagcuguauggggacucuaagccgcagaaauuuaccuccagcgcuaauggagucacaacccacuacguuucucaaaucggcggcuucccuaaccagacggaggaugggggacugccccaguccggcagaauugugguggacuauaugguccaaaagagcgggaaaacaggaaccaucaccuaccagcggggcauucuccugccucagaagguguggugcgccucugggcgcuccaaaguuaucaagggaagccuuccccugauuggcgaagcugauugucuccaugagaaauauggcgggcugaacaaguccaagcccuacuacacaggagagcacgccaaagcgaucggcaauugcccuaucugggugaagaccccgcugaaacucgccaacgggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaccucaagagcacccaggaggcuauuaauaaaaucacaaagaaccuuaauucccuuagcgaacuggagguuaaaaaccuccagcgccugucuggagccauggaugagcugcauaaugaaauucucgagcuggacgaaaagguggacgaucuuagagccgacaccaucuccagccaaaucgagcuggcuguccuccugucuaacgaaggcauuaucaauagcgaggaugagcaccuucuggcccucgaacggaaacugaagaagaugcuggggcccuccgcgguggagauuggcaacggauguuucgaaacaaaacauaagugcaaucagaccugccucgaccgcaucgcugccggcacguuugaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaaugucucuuguuccaucugccuguga

SEQ ID NO: 209765 - RNA, 1755 nt, Artificial Sequence
  derived and/or modified sequence opt5 from hemagglutinin__InfluenzaB__AFH58304
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacgauaagacacagaugaaaaaccuguauggcgacuccaauccgcaaaaguuuaccagcucugccaacgggguuacaacccacuacgugucccagaucggagauuucccugaccagacggaggauggcggccucccccagagcgggcggauuguggucgacuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaauaaguccaaaccuuauuacaccggcgaacacgcgaaggccaucgggaacugcccgauuugggugaagacaccccucaaacuggcuaacggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaucugaaaagcacgcaggaggccaucaauaagaucaccaagaaccuuaauucccugagcgaacucgaggucaaaaaccugcaaagacugucuggcgccauggacgaacuccauaaugagauucuggagcuugaugaaaagguggacgaucugcgggcugacacaaucuccagccagauugagcucgccguccugcuuucuaacgaagggaucauuaauagcgaggaugaacaucugcucgcgcuggagcgcaaacugaagaaaaugcucggaccuuccgcuguggacaucggcaacggguguuucgagaccaagcacaagugcaaucagacaugccuggauagaaucgccgccggcaccuuuaacgcuggagaguucucucuucccacguuugacagccugaauauuaccgccgcuucccucaacgaugacggccuggacaaucacacaauccugcuuuauuacagcaccgccgcgucuucccucgccguuacacugaugcuggcuauuuucaucguguauauggucagccgggauaacgugucuuguuccauuugccucuga

SEQ ID NO: 209766 - RNA, 1755 nt, Artificial Sequence; identical to SEQ ID NO: 209765
  derived and/or modified sequence opt5 from hemagglutinin__InfluenzaB__AFH58315

SEQ ID NO: 209767 - RNA, 1755 nt, Artificial Sequence
  derived and/or modified sequence opt5 from hemagglutinin__InfluenzaB__AFH58326
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaaggcccagaugaaaaaucuguauggcgauuccaacccgcaaaaguuuacaagcucugcuaaugggguuaccacacacuacgugucccagaucggagacuucccugaucagaccgaggacggcgggcccccucagagcggccggauuguggucgauuauaugaugcaaaagcccggaaaaacgggcacaaucguguaccagcgcgggguucuccugccccagaagguguggugcgccucuggaagauccaaagucaucaagggcagccuuccucugauuggggaagcggacugucuccaugagaaauacggaggccugaacaaguccaaaccguauuacaccggcgaacacgccaaggcuaucgggaacugccccauuugggugaagaccccucugaaacucgccaauggaacaaaguaucggcccccugcuaaacugcuuaaggagcgcggcuuuuucggggccaucgccggauuucuggagggcgggugggaaggcaugauugcuggauggcacggcuacaccucucauggggcgcacggaguugccguggcugccgaccucaaaagcacacaggaggccaucaacaagaucacgaagaaucugaacucccuuagcgaacuggaggucaaaaaucuccaaagacugucuggcgcuauggaugaacugcauaacgagauucucgagcuggacgaaaagguggaugaccuucgggccgauaccaucuccagccagauugagcuggcgguccuccugucuaaugaagggaucauuaacagcgaggacgaacaccuucuggcucucgagcgcaaacugaagaaaaugcugggacccuccgccguggauaucggcaauggguguuucgagacaaagcacaagugcaaccagaccugccucgacagaaucgccgcuggcacauuuaaugccggagaguucucucugccgaccuuugauagccuuaacauuacggcugccucccugaaugacgauggccucgacaaccauaccauccugcuguauuacagcacagcggccucuucccuugcuguuacccucaugcuggccauuuucaucguguauauggucagccgggacaaugugucuuguuccauuugccuguga

SEQ ID NO: 209768 - RNA, 1755 nt, Artificial Sequence
  derived and/or modified sequence opt5 from hemagglutinin__InfluenzaB__AFH58337
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaaggcccagaugaaaaaucuguauggcgauuccaacccgcaaaaguuuacaagcucugcuaaugggguuaccacacacuacgugucccagaucggagacuucccugaucagaccgaggacggcggccucccccagagcgggcggauuguggucgauuauaugaugcaaaagccuggaaaaacgggcacaaucguguaccagcgcgggguucugcuuccccagaagguguggugcgccucuggaagauccaaagucaucaagggcagccugccccucauuggggaagcggacugucugcaugagaaauacggaggccugaacaaguccaaaccuuauuacaccggcgaacacgccaaggcuaucgggaacugcccgauuugggugaagacaccccucaaacuggccaauggaaccaaguaucggccucccgcuaaacuucugaaggagcgcggcuuuuucggggccaucgccggauuucucgagggcgggugggaaggcaugauugcuggauggcacggcuacaccucucauggggcgcacggaguugccguggcugccgaccugaaaagcacacaggaggccaucaacaagaucacgaagaaucuuaacucccugagcgaacucgaggucaaaaaucugcaaagacugucuggcgcuauggaugaacuccauaacgagauucuggagcuugacgaaaagguggaugaccugcgggccgauaccaucuccagccagauugagcucgcgguccugcuuucuaaugaagggaucauuaacagcgaggacgaacaucugcucgcucuggagcgcaaacugaagaaaaugcucggaccuuccgccguggauaucggcaauggguguuucgagacaaagcacaagugcaaccagaccugccuggacagaaucgccgcuggcacauuuaaugccggagaguucucucuucccaccuuugauagccugaacauuacggcugccucccucaaugacgauggccuggacaaccacaccauccugcuuuauuacagcacagcggccucuucccucgcuguuacccugaugcuggccauuuucaucguguauauggucagccgggacaaugugucuuguuccauuugccucuga

SEQ ID NO: 209769 - RNA, 1758 nt, Artificial Sequence
  derived and/or modified sequence opt5 from hemagglutinin__InfluenzaB__AFH58348
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucugcccauaaugugauuaacgcugagaaugccccgggcggccccuauaaaaucgggacgagcggauccugcccuaacgucacaaauggcaacggguucuuugcuaccauggccugggcggugcccaagaaugacaacaauaaaacagccaccaacagccugaccauugaagugccuuacaucuguacagagggagaggaucagauuacggucuggggcuuccacucugacaaggaaacccagauggcuaaacuuuauggggauuccaagccccagaaguuuacaagcucugccaacggaguuaccacacacuacgugucccaaaucggcggcuucccgaaucagaccgaggacgggggacugccucagagcggcagaaucguggucgauuauauggugcagaaaucugggaagacgggaacaauuaccuaccaacggggcauccuccugccccagaaaguuuggugcgcuuccgggcgcagcaaggugauuaaaggaucccuuccucugaucggcgaagccgacugucuccaugagaaguauggcgggcugaacaaaucuaagcccuacuacaccggagagcacgcgaaggccauuggcaauugccccaucugggucaaaacaccucugaagcucgcuaacgggaccaaauauagaccgcccgccaagcugcuuaaagaacggggauuuuucggcgcuaucgccggguuucuggagggcggaugggaaggcaugauugccggguggcauggauacacaagccacggcgcucacgggguggcgguugccgcugaucucaaguccacgcaggaggccaucaauaagauuaccaaaaaccugaauagccuuucugaacuggaggugaagaaccuccagcgccuguccggagccauggacgagcugcauaaugaaauccucgagcuggaugaaaaagucgacgaccuuagagcugauacaauuagcucucaaaucgagcuggccgugcuccugagcaacgaaggcaucauuaauuccgaggacgagcaccuucuggcgcucgaacggaagcugaaaaagaugcuggggccuucugcugucgagaucggcaacggauguuucgaaaccaagcauaaaugcaaucagacaugccucgaucgcauugccgccggcaccuuuaacgcuggggaguucagccugcccacguuugacucccuuaauaucaccgccgcuagccugaacgaugacggacucgauaaccacacaauucugcuguauuacucuaccgccgcguccagccuugccgugacacucaugaucgcuauuuucguuguguauauggucucuagagacaauguguccuguagcaucugccuguga

SEQ ID NO: 209770 - RNA, 1758 nt, Artificial Sequence
  derived and/or modified sequence opt5 from hemagglutinin__InfluenzaB__AFH58370
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucugcccauaaugugauuaacgcugagaaugccccgggcggccccuauaaaaucgggacgagcggauccugcccuaacgucacaaauggcaacggguucuuugcuaccauggccugggcggugcccaagaaugacaacaauaaaacagccaccaacagccugaccauugaagugccuuacaucuguacagagggagaggaucagauuacggucuggggcuuccacucugacaacgaaauccagauggcuaaacuuuauggggauuccaagccccagaaguuuaccagcucugccaauggaguuacaacccacuacgugucccaaaucggcggcuucccgaaccagacagaggacgggggacugccucagagcggcagaauuguggucgauuauauggugcagaagucugggaaaaccggaacgaucacauaccaacggggcauucuccugccccagaagguuuggugcgcuuccgggcgcagcaaagugaucaagggaucccuuccucugauuggcgaagccgacugucuccaugagaaauauggcgggcugaauaagucuaaacccuacuacaccggagagcacgcgaaggccaucggcaacugccccaucugggucaagaccccucugaaacucgcuaaugggacaaaguauagaccgcccgccaaacugcuuaaggaacggggauuuuucggcgcuauugccggguuucuggagggcggaugggaaggcaugaucgccggguggcauggauacaccagccacggcgcucacgggguggcgguugccgcugaucucaaauccacacaggaggccauuaacaagaucacgaagaaucugaacagccuuucugaacuggaggugaaaaaucuccagcgccuguccggagccauggacgagcugcauaacgaaauucucgagcuggaugaaaaggucgacgaccuuagagcugauaccaucagcucucaaaucgagcuggccgugcuccugagcaaugaaggcauuaucaacuccgaggacgagcaccuucuggcgcucgaacggaaacugaagaaaaugcuggggccuucugcugucgagauuggcaauggauguuucgaaacaaagcauaagugcaaccagaccugccucgaucgcaucgccgccggcacauuuaaugcuggggaguucagccugcccaccuuugacucccuuaacauuacggccgcuagccugaacgaugacggacucgauaaucacaccauccugcuguauuacucuacagccgcguccagccuugccgugacccucaugauugcuaucuucguuguguauauggucucuagagacaacguguccuguagcaucugccuguga

SEQ ID NO: 209771 - RNA, 1758 nt, Artificial Sequence
  derived and/or modified sequence opt5 from hemagglutinin__InfluenzaB__AFH58392
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaauccagauggccaaacuuuauggggauucuaagccgcagaaguuuacauccagcgcuaacggagucaccacacacuacguuucucaaauuggcggcuucccuaaccagaccgaggacgggggacugccccaguccggcagaaucgugguggauuauaugguccaaaagagcgggaaaacgggaacaauuaccuaccagcggggcauccuccugccucagaagguguggugcgccucugggcgcuccaaaguuauuaagggaagccuuccccugaucggcgaagcugacugucuccaugagaaauauggcgggcugaauaaguccaagcccuacuacaccggagagcacgccaaagcgaucggcaacugcccuauuugggugaagacaccgcugaaacucgccaaugggaccaaguauagacccccugcuaaacugcuuaaggaacggggauuuuucggcgccaucgcuggguuucuggagggcggaugggaaggcaugauugccggguggcauggauacacaucucacggcgcccacggggucgcuguggcggccgaucucaagagcacgcaggaggcuaucaacaaaauuaccaagaaucugaacucccuuagcgaacuggagguuaaaaaucuccagcgccugucuggagccauggacgagcugcauaacgaaauccucgagcuggaugaaaagguggacgaccuuagagccgauacaaucuccagccaaauugagcuggcuguccuccugucuaaugaaggcaucauuaacagcgaggacgagcaccuucuggcccucgaacggaaacugaagaagaugcuggggcccuccgcgguggagaucggcaauggauguuucgaaaccaaacauaagugcaaccagacaugccucgaucgcauugcugccggcaccuuugacgccggggaguucucucugccuacguuugauagccuuaauaucaccgcugccucccugaacgacgauggacucgacaaucacacaauucugcuguauuacagcaccgcugccucuucccuugcggucacacucaugaucgccaucuucgugguuuauauggugagcagagauaacgucucuuguuccauuugccuguga

SEQ ID NO: 209772 - RNA, 1758 nt, Artificial Sequence; identical to SEQ ID NO: 209764
  derived and/or modified sequence opt5 from hemagglutinin__InfluenzaB__AFH58403

SEQ ID NO: 209773 - RNA, 1758 nt, Artificial Sequence; identical to SEQ ID NO: 209764
  derived and/or modified sequence opt5 from hemagglutinin__InfluenzaB__AFH58414

SEQ ID NO: 209774 - RNA, 1758 nt, Artificial Sequence; identical to SEQ ID NO: 209764
  derived and/or modified sequence opt5 from hemagglutinin__InfluenzaB__AFH58425

SEQ ID NO: 209775 - RNA, 1758 nt, Artificial Sequence; identical to SEQ ID NO: 209764
  derived and/or modified sequence opt5 from hemagglutinin__InfluenzaB__AFH58436

SEQ ID NO: 209776 - RNA, 1758 nt, Artificial Sequence
  derived and/or modified sequence opt5 from hemagglutinin__InfluenzaB__AFH58458
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgaacaaugugauuaacgccgagaaugcuccgggcggccccuauaagaucgggacaagcggauccugcccuaacgucaccaauggcaacggguucuuugccacaauggcuugggccgugcccaaaaaugacaagaacaaaaccgcgaccaauccucugacaauugaagugcccuacaucuguacggagggagaggaucagauuaccgucuggggcuuccauagcgacaacgaaauccagauggccaagcuguauggggauucuagaccgcagaaguuuacauccagcgcuaacggaguuaccacacacuacgugucucaaaucggcggcuucccuaaucagaccgaggacgggggacugccccaguccggccggauuguggucgauuauauggugcagaaaagcgggaagacgggaacaaucaccuaccaacgcggcauucuccugccucagaaaguuuggugcgccucugggagauccaaggugaucaaaggaagccuuccccugauuggcgaagcugacugucuccacgagaaguauggcgggcugaacaaauccaagcccuacuacaccggagagcaugccaaggcgaucggcaauugcccuaucugggucaaaacaccgcugaagcucgccaacgggaccaaauaucggcccccugcuaagcugcuuaaagaacgcggauuuuucggcgccauugcuggguuucuggagggcggaugggaaggcaugaucgccggguggcacggauacacaucucauggcgcccacgggguggcuguugcggccgaucucaagagcacgcaggaggcuauuaauaagaucaccaaaaaccuuaauucccuuagcgaacuggaggugaagaaccuccagagacugucuggagccauggacgagcugcacaaugaaauucucgagcuggaugaaaaagucgacgaccuucgggccgauacaaucuccagccaaaucgagcuggcugugcuccugucuaacgaaggcauuaucaauagcgaggacgagcaucuucuggcccucgaacgcaagcugaaaaagaugcuggggcccuccgcggucgagauuggcaacggauguuucgaaaccaagcacaaaugcaaucagacaugccucgauagaaucgcugccggcaccuuugacgccggggaguucucucugccuacguuugauagccuuaacauuaccgcugccucccugaaugacgauggacucgacaaccauacaauccugcuguauuacagcaccgcugccucuucccuugcggugacacucaugauugccaucuucguuguguauauggucagccgggauaacgugucuuguuccaucugccuguga

SEQ ID NO: 209777 - RNA, 1758 nt, Artificial Sequence; identical to SEQ ID NO: 209776
  derived and/or modified sequence opt5 from hemagglutinin__InfluenzaB__AFH58469

SEQ ID NO: 209778 - RNA, 1755 nt, Artificial Sequence; identical to SEQ ID NO: 209758
  derived and/or modified sequence opt5 from hemagglutinin__InfluenzaB__AFH58480

SEQ ID NO: 209779 - RNA, 1755 nt, Artificial Sequence
  derived and/or modified sequence opt5 from hemagglutinin__InfluenzaB__AFH58502
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacgauaagacacagaugaaaucccuguauggcgacagcaacccgcaaaaguuuaccucuuccgccaaugggguuacaacccacuacgugagccagaucggagauuucccugaccagacggaggauggcggccucccccagucugggcggauuguggucgacuauaugaugcaaaagccuggaaaaacaggcaccaucguguaccagcgcgggguucugcuuccccagaagguguggugcgcuuccggaagaagcaaagucaucaagggcucccugccccucauuggggaagccgacugucugcaugagaaauacggaggccugaacaagucuaaaccuuauuacaccggcgaacacgcgaaggccaucgggaauugcccgauuugggugaagacaccccucaaacuggcuaacggaaccaaguaucggccucccgccaaacuucugaaggagcgcggcuuuuucggggcuaucgccggauuucucgagggcgggugggaaggcaugauugccggauggcacggcuacacaagccauggggcucacggaguugcgguggccgcugaucugaaauccacgcaggaggccaucaacaagaucaccaagaaucuuaacagccugucugaacucgaggucaaaaaucugcaaagacuguccggcgccauggacgaacuccauaacgagauucuggagcuugaugaaaagguggacgaucugcgggcugacacaaucagcucucagauugagcucgccguccugcuuagcaaugaagggaucauuaacuccgaggaugaacaucugcucgcgcuggagcgcaaacugaagaaaaugcucggaccuucugcuguggacaucggcaauggguguuucgagaccaagcacaagugcaaccagacaugccuggauagaaucgccgccggcaccuuuaaugcuggagaguucagccuucccacguuugacucccugaacauuaccgccgcuagccucaaugaugacggccuggacaaccacacaauccugcuuuauuacucuaccgccgcguccagccucgccguuacacugaugcuggcuauuuucaucguguauauggucucucgggauaauguguccuguagcauuugccucuga

SEQ ID NO: 209780 - RNA, 1758 nt, Artificial Sequence
  derived and/or modified sequence opt5 from hemagglutinin__InfluenzaB__AFH58513
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacgaugaaacacagauggccaagcuguauggggacucuaagccucagaaauuuaccuccagcgcuaauggaguuacaacccacuacgugucucaaaucggcggcuuccccaaccagacggaggaugggggacuuccucaguccggcagaaucguggucgacuauauggugcaaaagagcgggaaaacaggaaccauuaccuaccagcggggcauccugcucccccagaagguuuggugcgccucugggcgcuccaaagugauuaagggaagccugccccuuaucggcgaagcugauugucugcaugagaaauauggcgggcucaacaaguccaagccuuacuacacaggagagcacgccaaagcgauuggcaauugcccgaucugggucaagacaccccugaaacuggccaacgggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaccugaaaagcacccaggaggcuaucaauaagauuacaaagaaccucaauucccugagcgaacuugaggugaaaaaccugcagcgccucucuggagccauggaugagcugcauaaugaaauccuggagcucgacgaaaaggucgacgaucugagagccgacaccauuuccagccaaaucgagcuugcugugcugcucucuaacgaaggcaucauuaauagcgaggaugagcaucugcuugcccuggaacggaaacucaagaagaugcuggggccuuccgcggucgagaucggcaacggauguuucgaaacaaaacacaagugcaaucagaccugccuggaccgcauugcugccggcacguuugaugccggggaguucucucuccccaccuuugacagccugaacaucacagcugccucccuuaaugaugacggacuggauaaccacaccauucuccuguauuacagcacagcugccucuucccuggcggugacccuuaugaucgccauuuucguuguguauauggucagcagagacaaugugucuuguuccaucugccucuga

SEQ ID NO: 209781 - RNA, 1758 nt, Artificial Sequence; identical to SEQ ID NO: 209780
  derived and/or modified sequence opt5 from hemagglutinin__InfluenzaB__AFH58524

SEQ ID NO: 209782 - RNA, 1755 nt, Artificial Sequence
  derived and/or modified sequence opt5 from hemagglutinin__InfluenzaB__AFH58535
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcaaacccgggggaagcugugucccaacugcuuuaauuguacagaucucgacguggcucugggacgcccuaaaugcaugggcaacacccccucugccaaggucagcauucuucacgaagugaagccugccacauccggguguuuccccaucaugcaugauagaaccaaaauccggcagcugccuaaucuccugcgcggauacgagaacauuagacugucuacgagcaauguuaucaacacagaaaccgcuccgggcggccccuauaagguggggacauccggaagcugcccuaaugucgccaacggcaauggguuuuucaacaccauggcuugggugauucccaaagacaauaacaagaccgccaucaacccugugacagucgagguucccuacauuuguucugaaggagaggaucagaucacgguguggggcuuucacuccgacgauaaaacccagauggagcggcucuauggggacagcaauccgcaaaaguucacaucuuccgcgaacggagugaccacacauuacgucagccagauuggcggcuuuccuaaucagaccgaagaugaggggcugaagcagucuggacgcaucgugguugacuauauggugcaaaaacccggcaagacggggacaaucgucuaccagagagggauucuucugccucagaaaguguggugcgccuccggccggagcaagguuaucaaagggucccucccccugauuggagaagcugauugucuucacgagaaguauggcggccugaacaaaucuaagcccuacuacaccggggagcacgccaaggcuaucggaaauugcccuauuugggugaaaaccccgcucaagcuggccaacggcacaaaauauagacccccugcgaagcugcucaaagaacgcggguucuuuggagccaucgcuggcuuccuggagggaggcugggaaggaaugaucgccggcuggcauggguacaccagccacggagcucauggcgucgccguggccgcugaccuuaaguccacacaggaggcgauuaauaagaucacgaaaaaccugaauuaucucagcgaacuggaggucaagaaccuucaacggcugucuggggccaugaaugagcuccacgaugaaauucuggagcuggacgaaaaaguggacgaucuccgcgcugacaccaucuccagccagauugagcuggccguucuucugucuaacgaaggaaucaucaauagcgaggaugagcaccuccuggcccuugaaagaaagcugaaaaagaugcucggccccuccgcuguggagauugggaacggcuguuuugaaacaaagcauaaaugcaaucagaccugccuggaccggaucgccgcgggaacauucaacgcuggcgauuuuucucugccuaccuucgacagccucaacauuacggccgccucccugaaugaugacgggcuugauaaccacaccauccugcucuacuauagcacagcugccucuucccuggcugucacccugaugauugccaucuucauuguguacaugguuagccgcgacaaugugucuuguuccaucugccuuuga

SEQ ID NO: 209783 - RNA, 1752 nt, Artificial Sequence
  derived and/or modified sequence opt5 from hemagglutinin__InfluenzaB__AFH58557
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaacgcgccccgggcggccccuauagacuggggaccagcggauccugcccuaacgucacaagccgggacggcuucuuugcuaccauggccugggcggugccccgcgauaauaaaaccgccacaaacccucuuacgguggagguccccuacauuuguaccaagggggaagaccagaucacaguuuggggauuccacucugaugacaaaacccagaugaagaaucuguauggcgauuccaacccgcaaaaauuuacaagcucugcuaauggggugaccacgcauuacgugucccagauuggaggcuucccuaaccagacagaggacggcgggcucccccagagcggaagaaucgucguggauuauaugguucaaaagccuggcaagaccgggaccauuguguaccagcggggaguccugcuuccccagaaaguguggugcgccucuggccgcuccaagguuaucaaagggagccugccccucaucggagaggcugacugucugcacgaaaaguauggcggccugaacaaauccaagccuuacuacacaggggagcacgccaaagcgauuggaaauugcccgaucugggugaagacaccccucaagcuggccaacggcaccaaauauagaccucccgcuaagcugcugaaagaacggggguuuuucggagccauugcuggcuuucucgaagggggcugggagggaaugaucgccggcuggcauggguacacgucucacggagcccauggcgucgcuguggcggccgaucuuaagagcacccaggaggcuauuaauaaaaucacaaagaaccuuaauucccugagcgagcucgaagucaagaaccugcaacgccugucuggggccauggacgagcuccacaaugaaauccuggagcuugacgagaaaguggaugaccugagagccgauaccauuuccagccagaucgaacucgcuguucugcuuucuaacgagggaauuaucaauagcgaagacgagcaucugcucgcccuggaacggaagcugaaaaagaugcucggcccuuccgcgguggauauugggaacggcuguuucgagacaaaacacaagugcaaucagaccugccuggacagaaucgcugccggaacguuuaacgccggcgaguucucuuuucccaccuucgauagccuuaauaucacagcugccucccugaacgacgaugggcucgacaaucacaccauucugcuguauuacagcacagcugccucuucccuugcggucacccucaugaucgccauuuucaucguguauaugguuagccgcgauaacgugucuuguuccauuugccuguga

SEQ ID NO: 209784 - RNA, 1755 nt, Artificial Sequence
  derived and/or modified sequence opt5 from hemagglutinin__InfluenzaB__AFJ76224
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggaucuccuaugugcgucggcauuacacccagcgccaaggccuccauccugcacgaagugcgcccuguuaccucuggguguuuucccaucaugcaugauagaacgaagauucggcaacucccuaaucugcugcgcggauacgagaaaaucagacucagcacacagaacgugauuaauaucgaaaaggcuccgggcggccccuaucggcuggggaccuccggaagcugcccuaacgccacaucucgcuccggcuucuuugcuaccauggccugggcgguccccagagacaauaacaaaaccgccacaaauccucuuacgguggaggugccccacauuuguaccaaggaagaggaucagaucacagucuggggguuccauagcgacaacaaaacccagaugaagaaucuguacggagauucuaacccgcaaaaguuuacauccagcgcuaauggcguuaccacgcacuaugugucucagauugggggauucccugaccagacagaggauggcggccucccccaguccgggcggaucguggucgacuacauggugcaaaaaccuggaaagaccggcaccaucguuuaucagcgcgggauucugcuuccccagaaaguguggugcgccagcggaagauccaaggucaucaaaggcucucugccccucauuggggaagcugauugucugcacgagaaguacggaggccugaacaaaagcaagccuuauuacacaggcgaacaugccaaggcgaucgggaacugcccgauuugggugaaaacaccccucaagcuggccaauggaacaaaauaccggccucccgcuaagcugcugaaagagcgcggcuuuuucggggccaucgcuggauuucucgagggcgggugggaaggcaugaucgccggauggcacggcuauacgucccauggggcccacggaguugcuguggcggccgaccuuaagagcacccaggaggcuauuaacaagaucaccaaaaaucuuaacucucuguccgaacucgaggucaagaaucugcaaagacugagcggcgccauggaugaacuccacaacgagauucuggagcuugacgaaaaaguggacgaucugcgggccgacaccaucucuagccagauugagcucgcuguccugcuuuccaaugaagggaucaucaacucugaggaugaacaucugcucgcccuggagcgcaagcugaaaaagaugcucggaccuagcgcgguggacauuggcaauggguguuucgagacaaagcacaaaugcaaccagaccugccuggauagaaucgcugccggcacguuuaaugccggagaguucucccuucccaccuuugacagccugaacauuacagcugccucucucaaugaugacggccuggauaaccauaccauccugcuuuacuauuccacagcugccagcucucucgcgguuacccugaugauugccaucuucauuguguacaugaucucccgggacaaugucagcuguuccaucugccuguga

SEQ ID NO: 209785 - RNA, 1755 nt, Artificial Sequence
  derived and/or modified sequence opt5 from hemagglutinin__InfluenzaB__AFJ76235
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggaucuccuaugugcgucggcauuacacccagcgccaaggccuccauccugcacgaagugcgcccuguuaccucuagauguuuucccaucaugcaugaucggacgaagauucgccaacucccuaaucugcugagaggguacgagaaaauccggcucagcacacagaacgugauuaauaucgaaaaggcuccgggaggccccuaucgccugggcaccuccgggagcugcccuaacgccacaucuagauccggauucuuugcuaccauggccugggcggucccccgggacaauaacaaaaccgccacaaauccucuuacgguggaggugccccacauuuguaccaaggaagaggaucagaucacagucuggggcuuccauagcgacaacaaaacccagaugaagaaucuguacggggauucuaacccgcaaaaguuuacauccagcgcuaauggaguuaccacgcacuaugugucucagauuggcggguucccugaccagacagaggauggaggccucccccaguccggccgcaucguggucgacuacauggugcaaaaaccugggaagaccggaaccaucguuuaucagagaggcauucugcuuccccagaaaguguggugcgccagcgggcgguccaaggucaucaaaggaucucugccccucauuggcgaagcugauugucugcacgagaaguacgggggacugaacaaaagcaagccuuauuacacaggcgaacaugccaaggcgaucggcaacugcccgauuugggugaaaacaccccucaagcuggccaaugggacaaaauaccgcccucccgcuaagcugcugaaagagagaggauuuuucggcgccaucgcuggguuucucgagggaggcugggaagggaugaucgccggcuggcacggauauacgucccauggcgcccacgggguugcuguggcggccgaccuuaagagcacccaggaggcuauuaacaagaucaccaaaaaucuuaacucucuguccgaacucgaggucaagaaucugcaacggcugagcggagccauggaugaacuccacaacgagauucuggagcuugacgaaaaaguggacgaucugcgcgccgacaccaucucuagccagauugagcucgcuguccugcuuuccaaugaaggcaucaucaacucugaggaugaacaucugcucgcccuggagagaaagcugaaaaagaugcucgggccuagcgcgguggacauuggaaauggcuguuucgagacaaagcacaaaugcaaccagaccugccuggaucggaucgcugccgggacguuuaaugccggcgaguucucccuucccaccuuugacagccugaacauuacagcugccucucucaaugaugacggacuggauaaccauaccauccugcuuuacuauuccacagcugccagcucucucgcgguuacccugaugauugccaucuucauuguguacaugaucuccagagacaaugucagcuguuccaucugccuguga

SEQ ID NO: 209786 - RNA, 1755 nt, Artificial Sequence; identical to SEQ ID NO: 209784
  derived and/or modified sequence opt5 from hemagglutinin__InfluenzaB__AFJ76246

SEQ ID NO: 209787 - RNA, 1758 nt, Artificial Sequence; identical to SEQ ID NO: 209538
  derived and/or modified sequence opt5 from hemagglutinin__InfluenzaB__AFJ76268

SEQ ID NO: 209788 - RNA, 1758 nt, Artificial Sequence; identical to SEQ ID NO: 209589
  derived and/or modified sequence opt5 from hemagglutinin__InfluenzaB__AFJ76301

SEQ ID NO: 209789 - RNA, 1755 nt, Artificial Sequence; identical to SEQ ID NO: 209450
  derived and/or modified sequence opt5 from hemagglutinin__InfluenzaB__AFJ76323

SEQ ID NO: 209790 - RNA, 1758 nt, Artificial Sequence
  derived and/or modified sequence opt5 from hemagglutinin__InfluenzaB__AFJ76334
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacuccgaaacacagauggccaaacuuuauggggauagcaaaccccagaaguuuaccucuuccgcuaacggaguuacaacccacuacgugagccaaaucggcggcuucccgaaucagacggaggacgggggacugccucagucuggcagaaucguggucgauuauauggugcagaaguccgggaaaacaggaaccauuaccuaccaacggggcauccuccugccccagaagguuuggugcgccagcgggcgcuccaaagugauuaagggaucucuuccucugaucggcgaagcugacugucuccaugagaaauauggcgggcugaacaagagcaaacccuacuacacaggagagcacgccaaggcgauuggcaauugccccaucugggucaagaccccucugaaacucgccaacgggacaaaguauagaccgcccgcuaaacugcuuaaggaacggggauuuuucggcgccaucgcuggguuucuggagggcggauggaaaggcaugauugccggguggcauggauacacgucccacggcgcccacgggguggcuguugcggccgaucucaagagcacccaggaagcuaucaauaagauuacaaagaaccuuaauucucuguccgagcuggaagugaagaaccuccagcgccugagcggagccauggacgagcugcauaaugagauccucgaacuggaugagaaagucgacgaccuuagagccgauaccauuucuagccaaaucgaacuggcugugcuccuguccaacgagggcaucauuaauucugaagacgagcaccuucuggcccucgagcggaagcugaaaaagaugcuggggccuagcgcggucgaaaucggcaacggauguuucgagacaaagcauaaaugcaaucagaccugccucgaucgcauugcugccggcacguuugacgccggggaguucucccugcccaccuuugauagccuuaacaucacagcugccucucugaaugacgauggacucgacaaccacaccauucugcuguauuacuccacagcugccagcucucuugcggugacccucaugaucgccguuuucguggucuauaugguguccagagauaacguuagcuguuccauuugccuguga

SEQ ID NO: 209791 - RNA, 1758 nt, Artificial Sequence; identical to SEQ ID NO: 209538
  derived and/or modified sequence opt5 from hemagglutinin__InfluenzaB__AFJ77327

SEQ ID NO: 209792 - RNA, 1755 nt, Artificial Sequence; identical to SEQ ID NO: 209450
  derived and/or modified sequence opt5 from hemagglutinin__InfluenzaB__AFJ77369

SEQ ID NO: 209793 - RNA, 1755 nt, Artificial Sequence; identical to SEQ ID NO: 209450
  derived and/or modified sequence opt5 from hemagglutinin__InfluenzaB__AFJ77380

SEQ ID NO: 209794 - RNA, 1755 nt, Artificial Sequence
  derived and/or modified sequence opt5 from hemagglutinin__InfluenzaB__AFJ80139
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacgcuacaagcagaucuggcuucuuugccaccauggcgugggccgucccccgggacaauaacaaaaccgcuacaaauccucuuacgguggaggugcccuacaucuguaccaaggaagaggaucagauuacagucuggggguuccacuccgacaacaaaacccagaugaagaaucuguauggagauagcaacccgcaaaaguuuacaucuuccgccaauggcguuaccacgcauuacgugagccagaucgggggauucccugaccagacagaggauggcggccucccccagucugggcgcauuguggucgacuauauggugcaaaaaccuggaaagaccggcaccaucguuuaccagagagggauccugcuuccccagaaaguguggugcgcuuccggacggagcaaggucauuaaaggcuuucugccccucaucggggaagccgauugucugcacgagaaguauggaggccugaacaaauccaagccuuacuacacaggcgaacacgcgaaggccauugggaacugcccgaucugggugaaaacaccccucaagcuggcuaauggaacaaaauaucgcccucccgccaagcugcugaaagagagaggcuucuuuggggcuauugccggauuccucgagggcgggugggaaggcaugaucgccggauggcauggcuacacgucucacggggcucauggaguugcgguggccgcugaccuuaagagcacccaggaggccaucaacaagauuaccaaaaaucuuaacucccugagcgaacucgaggucaagaaucugcaacggcugucuggcgccauggaugaacuccacaacgagauccuggagcuugacgaaaaaguggacgaucugcgcgcugacaccauuuccagccagaucgagcucgccguccugcuuucuaaugaagggauuaucaacagcgaggaugaacaucugcucgcgcuggagagaaagcugaaaaagaugcucggaccuuccgcuguggacaucggcaauggguguuuugagacaaagcacaaaugcaaccagaccugccuggaucggauugccgccggcacguucaaugcuggagaauuuucucuucccaccuucgacagccugaacaucacagccgcuucccucaaugaugacggccuggauaaccacaccauucugcuuuauuacagcacagccgcgucuucccucgccguuacccugaugaucgcuauuuucaucguguauaugauuagcagagacaaugucucuuguuccaucugccuguga

SEQ ID NO: 209795 - RNA, 1755 nt, Artificial Sequence
  derived and/or modified sequence opt5 from hemagglutinin__InfluenzaB__AFJ80150
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacgcuacaagcagaucuggcuucuuugccaccauggcgugggccgucccccgggacaauaacaaaaccgcuacaaauccucuuacgguggaggugcccuacaucuguaccaaggaagaggaucagauuacagucuggggguuccacuccgacaacaaaacccagaugaagaaucuguauggagauagcaacccgcaaaaguuuacaucuuccgccaauggcguuaccacgcauuacgugagccagaucgggggauucccugaccagacagaggauggcggccucccccagucugggcgcauuguggucgacuauauggugcaaaaaccuggaaagaccggcaccaucguuuaccagagagggauccugcuuccccagaaaguguggugcgcuuccggacggagcaaggucauuaaaggcucccugccccucaucggggaagccgauugucugcacgagaaguauggaggccugaacaaaucuaagccuuacuacacaggcgaacacgcgaaggccauugggaacugcccgaucugggugaaaacaccccucaagcuggcuaauggaacaaaauaucgcccucccgccaagcugcugaaagagagaggcuuuuucggggcuauugccggauuucucgagggcgggugggaaggcaugaucgccggauggcauggcuacacgagccacggggcucauggaguugcgguggccgcugaccugaaguccacccaggaggccaucaacaagauuaccaaaaaucuuaacagccugucugaacucgaggucaagaaucugcaacggcuguccggcgccauggaugaacuccacaacgagauccuggagcuugacgaaaaaguggacgaucugcgcgcugacaccauuagcucucagaucgagcucgccguccugcuuagcaaugaagggauuaucaacuccgaggaugaacaccuucucgcgcuggagagaaagcugaaaaagaugcucggaccuucugcuguggacaucggcaauggguguuucgagacaaagcauaaaugcaaccagaccugccuggaucggauugccgccggcacguuuaaugcuggagaguucagccuucccaccuuugacucccugaacaucacagccgcuagccucaaugaugacggccuggauaaccacaccauucugcuuuauuacucuacagccgcguccagccucgccguuacccugaugaucgcuauuuucaucguguauaugauuucuagagacaaugucuccuguagcaucugccuguga

SEQ ID NO: 209796 - RNA, 1755 nt, Artificial Sequence
  derived and/or modified sequence opt5 from hemagglutinin__InfluenzaB__AFJ80161
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcagaucuggcuucuuugcgaccauggccugggcugugccccgggacaauaacaaaaccgccacaaauccucuuacggucgaggugccccacaucuguaccaaggaagaggaucagauuacaguguggggguuccauuccgacaacaaaacccagaugaagaaucuguacggagauagcaacccgcaaaaguuuacaucuuccgcuaauggcaucaccacgcacuaugucagccagauugggggauucccugaccagacagaggauggcggccucccccagucugggcgcaucguuguggacuacauggugcaaaaaccuggaaagaccggcaccaucgucuaucagagagggauucugcuuccccagaaaguguggugcgccuccggacggagcaagguuaucaaaggcucccugccccucauuggggaagcggauugucugcacgagaaguacggaggccugaacaaaucuaagccuuauuacacaggcgaacaugccaaggcuaucgggaacugcccgauuugggugaaaacaccccucaagcuggccaauggaacaaaauaccgcccucccgcuaaacuucugaaggagagaggcuuuuucggggccaucgccggauuucucgagggcgggugggaaggcaugaucgcuggauggcacggcuauacgagccauggggcgcacggagucgccguggcugccgaccugaaguccacccaggaggccauuaacaagaucaccaaaaaucuuaacagccugucugaacucgagguuaagaaucugcaacggcuguccggcgcuauggaugaacuccacaacgagauucuggagcuugacgaaaaaguggacgaucugcgcgccgacaccaucagcucucagauugagcucgcgguccugcuuagcaaugaagggaucaucaacuccgaggaugaacaucugcucgcucuggagagaaagcugaaaaagaugcucggaccuucugccguggacauuggcaauggguguuucgagacaaagcacaaaugcaaccagaccugccuggaucggaucgccgcuggcacguuuaaugccggagaguucagccuucccaccuuugacucccugaacauuacagcugccagccucaaugaugacggccuggauaaccauaccauccugcuuuacuauucuacagcggccuccagccucgcugucacccugaugauugccaucuucauuguguacaugaucuucagagacaauguuucuuguuccaucugccuguga

SEQ ID NO: 209797 - RNA, 1755 nt, Artificial Sequence
  derived and/or modified sequence opt5 from hemagglutinin__InfluenzaB__AFJ80172
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcauuacacccucugccaaggccagcauccugcacgaagugagaccuguuaccuccggguguuuucccaucaugcaugaucggacgaagauucgccaacucccuaaucugcugagaggauacgagaaaauccggcucucuacacagaacgugauuaaugcugaaaaggccccgggcggccccuaucgccuggggaccagcggauccugcccuaacgcuacaagcagaucuggcuucuuugccaccauggcgugggccgucccccgggacaauaacaaaaccgcuacaaauccucuuacgguggaggugcccuacaucuguaccaaggaagaggaucagauuacagucuggggguuccacuccgacaacaaaacccagaugaagaaucuguauggagauagcaacccgcaaaaguuuacaucuuccgccaauggcguuaccacgcauuacgugagccagaucggggacuucccugaucagacagaggacggaggccucccccagucuggccgcauuguggucgauuauauggugcaaaaaccugggaagaccggaaccaucguuuaccagagaggcauccugcuuccccagaaaguguggugcgcuuccgggcggagcaaggucauuaaaggaucccugccccucaucggcgaagccgacugucugcacgagaaguaugggggacugaacaaaucuaagccuuacuacacaggcgaacacgcgaaggccauuggcaacugcccgaucugggugaaaacaccccucaagcuggcuaaugggacaaaauaucgcccucccgccaagcugcugaaagagagaggauuuuucggcgcuauugccggguuucucgagggaggcugggaagggaugaucgccggcuggcauggauacacgagccacggcgcucaugggguugcgguggccgcugaucugaaguccacccaggaggccaucaacaagauuaccaaaaaucuuaacagccugucugaacucgaggucaagaaucugcaacggcuguccggagccauggacgaacuccacaacgagauccuggagcuugacgaaaaaguggaugaccugcgcgcugauaccauuagcucucagaucgagcucgccguccugcuuagcaaugaaggcauuaucaacuccgaggacgaacaccuucucgcgcuggagagaaagcugaaaaagaugcucgggccuucugcuguggauaucggaaauggcuguuucgagacaaagcauaaaugcaaccagaccugccuggaccggauugccgccgggacguuuaaugcuggcgaguucagccuucccaccuuugauucccugaacaucacagccgcuagccucaaugacgauggacuggacaaccacaccauucugcuuuauuacucuacagccgcguccagccucgccguuacccugaugaucgcuauuuucaucguguauaugauuucuagagauaaugucuccuguagcaucugccuguga

SEQ ID NO: 209798 - RNA, 1755 nt, Artificial Sequence; identical to SEQ ID NO: 209784
  derived and/or modified sequence opt5 from hemagglutinin__InfluenzaB__AFJ80183

SEQ ID NO: 209799 - RNA, 1755 nt, Artificial Sequence; identical to SEQ ID NO: 209795
  derived and/or modified sequence opt5 from hemagglutinin__InfluenzaB__AFJ80194

SEQ ID NO: 209800 - RNA, 1755 nt, Artificial Sequence; identical to SEQ ID NO: 209784
  derived and/or modified sequence opt5 from hemagglutinin__InfluenzaB__AFJ80205

SEQ ID NO: 209801 - RNA, 1755 nt, Artificial Sequence; identical to SEQ ID NO: 209429
  derived and/or modified sequence opt5 from hemagglutinin__InfluenzaB__AFJ80216

SEQ ID NO: 209802 - RNA, 1755 nt, Artificial Sequence; identical to SEQ ID NO: 209784
  derived and/or modified sequence opt5 from hemagglutinin__InfluenzaB__AFJ80227

SEQ ID NO: 209803 - RNA, 1758 nt, Artificial Sequence
  derived and/or modified sequence opt5 from hemagglutinin__InfluenzaB__AFJ80238
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuauucauaaugugaucaacgccgaaaaagcuccgggcggccccuauaagauugggacgagcggauccugcccuaaugucacaaacggcaauggguucuuugccaccauggcuugggccgugcccaaaaacgacaauaacaagacagcgaccaauagccugaccaucgaggugccuuacauuuguacagaaggagaggaucagaucacggucuggggcuuccacucugacaacgagacccagauggccaaacuuuauggggauuccaagccccagaaguuuacaagcucugcuaacggaguuaccacacacuacgugucccaaaucggcggcuucccgaaucagaccgaagacgggggacugccucagagcggccgcauuguggucgauuauauggugcagaaaucugggaagacgggaacaaucaccuaccaaagaggcauucuccugccccagaaaguuuggugcgccuccgggcggagcaaggugaucaaaggaucccuuccucugauuggcgaggcugacugucuccaugaaaaguauggcgggcugaacaagucuaaacccuacuacaccggagagcacgccaaggcgaucggcaauugccccaucugggucaaaacaccucugaagcucgccaacgggaccaaauaucgcccgcccgcuaagcugcuuaaggagagaggauuuuucggcgccauugcuggguuucuggaaggcggaugggagggcaugaucgccggguggcauggauacacaagccacggcgcccacgggguggcuguugcggccgaucucaaauccacgcaggaagcuauuaauaagaucaccaaaaaccugaauagccuuucugagcuggaagugaagaaccuccagcggcuguccggagccauggacgagcugcauaaugagauucucgaacuggaugagaaagucgacgaccuucgcgccgauacaaucagcucucaaaucgaacuggcugugcuccugagcaacgagggcauuaucaauuccgaagacgagcaccuucuggcccucgagagaaagcugaagaaaaugcuggggccuucugcggucgaaauuggcaacggauguuucgagaccaagcauaaaugcaaucagacaugccucgaucggaucgcugccggcaccuuugacgccggggaguucagccugcccacguuugauucccuuaacauuaccgcugccagccugaaugacgauggacucgacaaccacacaauccugcuguauuacucuaccgcugccuccagccuugcggugacacucaugauugccaucuucguuguguauauggucucucgcgauaacguguccuguagcaucugccuguga

SEQ ID NO: 209804 - RNA, 1755 nt, Artificial Sequence
  derived and/or modified sequence opt5 from hemagglutinin__InfluenzaB__AFJ80656
augaaggccaucauugugcugcucauggucguuaccagcaacgcugacagaaucugcacaggcauuacguccucuaauagcccccacguggugcggaccgccacacagggggaagucaacgugaccggaguuaucccucugacaaccacaccgaccaaaucccauuucgcgaaucuuaagggcacgaaaacccgcgggaagcugugucccacaugccucaacuguaccgaucuggacguggcucuuggaagaccuaugugcgucggcauuacacccucugccaaagccagcauccugcacgaagugcggccuguuaccuccggguguuuucccaucaugcaugaucgcacgaagauuagacaacucccuaaucugcugcggggauacgagaagauccgccucucuacacagaacgugauuaaugcugaaaaagccccgggcggccccuauagacuggggaccagcggauccugcccuaacgcuacaagccggucuggcuucuuugccaccauggcgugggccgucccccgcgacaauaacaagaccgcuacaaauccucuuacgguggaggugccccacaucuguaccaaagaagaggaucagauuacagucuggggguuccauuccgacaacaagacccagaugaaaaaucuguacggagauagcaacccgcaaaaguuuacaucuuccgccaauggcguuaccacgcacuaugugagccagaucgggggauucccugaccagacagaggauggcggccucccccagucugggagaauuguggucgacuacauggugcaaaagccuggaaaaaccggcaccaucguuuaucagcgggggauccugcuuccccagaagguguggugcgcuuccggacgcagcaaagucauuaagggcucccugccccucaucggggaagccgauugucugcacgagaaauacggaggccugaacaagucuaaaccuuauuacacaggcgaacaugcgaaggccauugggaacugcccgaucugggugaagacaccccucaaacuggcuaauggaaccaaguacagaccucccgccaaacuucugaaggagcggggcuuuuucggggcuauugccggauuucucgagggcgggugggaaggcaugaucgccggauggcacggcuauacgagccauggggcucacggaguugcgguggccgcugaccugaaauccacccaggaggccaucaacaagauuacaaagaaucuuaacagccugucugaacucgaggucaaaaaucugcaacgccuguccggcgccauggaugaacuccacaacgagauccuggagcuugacgaaaagguggacgaucugagagcugacaccauuagcucucagaucgagcucgccguccugcuuagcaaugaagggauuaucaacuccgaggaugaacaucugcucgcgcuggagcggaaacugaagaaaaugcucggaccuucugcuguggacaucggcaauggguguuucgagacaaagcacaagugcaaccagaccugccuggauagaauugccgccggcacguuuaaugcuggagaguucagccuucccaccuuugacucccugaacaucacagccgcuagccucaaugaugacggccuggauaaccauaccauucugcuuuacuauucuacagccgcguccagccucgccguuacccugaugaucgcuauuuucaucguguacaugauuucucgcgacaaugucuccuguagcaucugccuguga

SEQ ID NO: 209805 - RNA, 1755 nt, Artificial Sequence; identical to SEQ ID NO: 209784
  derived and/or modified sequence opt5 from hemagglutinin__InfluenzaB__AFJ80667

SEQ ID NO: 209806 - RNA, 1755 nt, Artificial Sequence; identical to SEQ ID NO: 209784
  derived and/or modified sequence opt5 from hemagglutinin__InfluenzaB__AFJ80678

SEQ ID NO: 209807 - RNA, 1755 nt, Artificial Sequence; identical to SEQ ID NO: 209784
  derived and/or modified sequence opt5 from hemagglutinin__InfluenzaB__AFJ80689

SEQ ID NO: 209808 - RNA, 1755 nt, Artificial Sequence
  derived and/or modified sequence opt5 from hemagglutinin__InfluenzaB__AFJ80711
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgauuaaguccuacuucgcgaaucuuaaaggcaccaagacgcgggggaaacugugucccgauugccucaacuguaccgaccuggauguggcucuuggacgcccuaugugcgucggcacaacccccucugccaaggccagcauccugcaugaagugagaccuguuacauccggguguuuucccaucaugcacgaccggaccaagauucgccaacucccuaaucugcugagaggauaugagaacauccggcucucuacgcagaaugugauugaugcugaaaaagccccgggcggccccuaccgccuggggacaagcggauccugcccuaacgcuaccagcaagucuggcuucuuugccacaauggcgugggccguccccaaagacaauaacaagaaugcuaccaacccucuuaccguggaggugcccuaugucuguacagaaggggaggaucagaucacgguuuggggauuccauuccgacaauaaaacccagaugaagaaccuguacggcgauagcaauccgcaaaaguuuacaucuuccgccaacggggugaccacacacuaugugagccagauuggaggcuucccugaccagaccgaggauggcgggcucccccagucuggaagaaucgucguggacuacaugguucaaaaaccuggcaagacggggacaauuguguaucagcggggaguccugcuuccccagaaaguguggugcgcuuccggccgcagcaagguuaucaaagggucccugccccucaucggagaagccgauugucugcaugagaaguacggcggccugaacaaaucuaagccuuacuauaccggggaacacgcgaaggccauuggaaauugcccgaucugggugaaaacaccccucaagcuggcuaacggcaccaaauacagaccucccgccaagcugcugaaagagcggggguuuuucggagcuauugccggcuuucucgaagggggcugggaaggaaugaucgccggcuggcacggguauaccagccauggagcucacggcgucgcgguggccgcugaccugaaguccacacaggaggccauuaauaagaucacgaaaaaccuuaauagccugucugaacucgaggucaagaaccugcaacgccuguccggggccauggacgaacuccauaaugagauccuggagcuugaugaaaaaguggacgaucugagagcugacaccauuagcucucagaucgagcucgccguucugcuuagcaacgaaggaauuaucaauuccgaggaugaacaccuucucgcgcuggagcggaagcugaaaaagaugcucggcccuucugcuguggacauugggaacggcuguuucgagacaaagcacaaaugcaaucagaccugccuggaucgcaucgccgccggaacauuuaacgcuggcgaguucagccuucccaccuuugacucccugaauaucacggccgcuagccucaacgaugacgggcuggauaaucauaccauucugcuuuacuauucuacagccgcguccagccucgccgucacccugaugcuggcuaucuucauuguguacaugguuucuagagacaacguguccuguagcaucugccucuga

SEQ ID NO: 209809 - RNA, 1755 nt, Artificial Sequence; identical to SEQ ID NO: 209808
  derived and/or modified sequence opt5 from hemagglutinin__InfluenzaB__AFJ80722

SEQ ID NO: 209810 - RNA, 1755 nt, Artificial Sequence
  derived and/or modified sequence opt5 from hemagglutinin__InfluenzaB__AFJ80733
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcaugggcaccacacccucugccaaagccagcauucugcaugaaguccggccugugaccuccggguguuuucccaucaugcacgaccgcacgaagaucagacaacucccuaaucugcugcggggauaugagaacauucgccucucuacacagaauguuaucgaugcugaaaaggccccgggcggccccuacagacuggggaccagcggauccugcccugacgcuacaaacaaaagcggcuucuuugccaccauggcgugggccgugcccaaggauaauaacaaaaaugcuaccaacccucuuacagucgaggugcccuauauuuguacggaaggggaggaccagaucaccguguggggauuccauucugauaauaagacacagaugaaaaaccuguacggcgacuccaauccgcaaaaguuuaccagcucugccaacggggucacaacccacuauguuucccagauuggaggcuucccugaucagacggaggacggcgggcucccccagagcggacggaucgugguggauuacaugaugcaaaagccuggcaaaacagggaccauugucuaucagcgcggagugcugcuuccccagaagguuuggugcgcuucuggcagauccaaagugaucaaggggagccugccccucaucggagaagccgacugucugcaugagaaauacggcggccugaacaaguccaaaccuuacuauaccggggaacacgcgaaggccauuggaaauugcccgaucugggucaagacaccccucaaacuggcuaacggcaccaaguaccggccucccgccaaacuucugaaggagcgcggguuuuucggagcuauugccggcuuucucgaagggggcugggaaggaaugaucgccggcuggcacggguauacaucucauggagcucacggcguggcgguugccgcugaccugaaaagcacgcaggaggccauuaauaagaucaccaagaaccuuaauucccugagcgaacucgaggugaaaaaccugcaaagacugucuggggccauggaugaacuccauaaugagauccuggagcuugacgaaaaggucgaugaccugcgggcugauacaauuuccagccagaucgagcucgccgugcugcuuucuaacgaaggaauuaucaauagcgaggacgaacaucugcucgcgcuggagcgcaaacugaagaaaaugcucggcccuuccgcugucgauauugggaacggcuguuucgagaccaagcacaagugcaaucagacaugccuggacagaaucgccgccggaaccuuuaacgcuggcgaguucucucuucccacguuugauagccugaauaucaccgccgcuucccucaacgacgaugggcuggacaaucacacaauucugcuuuacuauagcaccgccgcgucuucccucgccgugacacugaugcuggcuaucuucauuguuuacauggugagccgggacaacgucucuuguuccaucugccucuga

SEQ ID NO: 209811 - RNA, 1758 nt, Artificial Sequence; identical to SEQ ID NO: 209538
  derived and/or modified sequence opt5 from hemagglutinin__InfluenzaB__AFJ80744

SEQ ID NO: 209812 - RNA, 1758 nt, Artificial Sequence; identical to SEQ ID NO: 209538
  derived and/or modified sequence opt5 from hemagglutinin__InfluenzaB__AFJ80755

SEQ ID NO: 209813 - RNA, 1758 nt, Artificial Sequence; identical to SEQ ID NO: 209538
  derived and/or modified sequence opt5 from hemagglutinin__InfluenzaB__AFJ80781

SEQ ID NO: 209814 - RNA, 1758 nt, Artificial Sequence; identical to SEQ ID NO: 209538
  derived and/or modified sequence opt5 from hemagglutinin__InfluenzaB__AFJ80792

SEQ ID NO: 209815 - RNA, 1758 nt, Artificial Sequence; identical to SEQ ID NO: 209538
  derived and/or modified sequence opt5 from hemagglutinin__InfluenzaB__AFJ80803

SEQ ID NO: 209816 - RNA, 1758 nt, Artificial Sequence; identical to SEQ ID NO: 209538
  derived and/or modified sequence opt5 from hemagglutinin__InfluenzaB__AFJ80814

SEQ ID NO: 209817 - RNA, 1758 nt, Artificial Sequence
  derived and/or modified sequence opt5 from hemagglutinin__InfluenzaB__AFJ80825
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuaucacauccggguguuuucccauuaugcaugaucgcaccaagaucagacaacucccuaaccugcugcggggauacgaacacauucgccucucuacgcauaauguuaucaacgccgagaaugcuccgggcggccccuauaaaauugggacaagcggauccugcccuaacgugaccaauggcaacggguucuuugccacaauggcuugggccguccccaagaaugacaacaauaaaaccgcgaccaacagccugacaaucgaagugccuuacauuuguacggagggagaggaucagaucaccguguggggcuuccacucugacaacgaaacacagauggccaaacuuuauggggauuccaagccccagaaguuuaccagcucugcuaauggagucacaacccacuacguuucccaaaucggcggcuucccgaaccagacggaggacgggggacugccucagagcggcagaauugugguggauuauaugguccagaagucugggaaaacaggaaccaucaccuaccaacggggcauucuccugccccagaagguguggugcgccuccgggcgcagcaaaguuaucaagggaucccuuccucugauuggcgaagcugacugucuccaugagaaauauggcgggcugaauaagucuaaacccuacuacacaggagagcacgccaaggcgaucggcaacugccccaucugggugaagaccccucugaaacucgccaaugggacaaaguauagaccgcccgcuaaacugcuuaaggaacggggauuuuucggcgccauugcuggguuucuggagggcggaugggaaggcaugaucgccggguggcauggauacacgagccacggcgcccacggggucgcuguggcggccgaucucaaauccacccaggaggcuauuaacaagaucacaaagaaucugaacagccuuucugaacuggagguuaaaaaucuccagcgccuguccggagccauggacgagcugcauaacgaaauucucgagcuggaugaaaagguggacgaccuuagagccgauaccaucagcucucaaaucgagcuggcuguccuccugagcaaugaaggcauuaucaacuccgaggacgagcaccuucuggcccucgaacggaaacugaagaaaaugcuggggccuucugcgguggagauuggcaauggauguuucgaaacaaagcauaagugcaaccagaccugccucgaucgcaucgcugccggcacguuugacgccggggaguucagccugcccaccuuugauucccuuaauauuacagcugccagccugaacgacgauggacucgacaaccacaccauccugcuguauuacucuacagcugccuccagccuugcggucacccucaugauugccaucuucgugguuuauauggugucuagagauaaugucuccuguagcaucugccuguga

SEQ ID NO: 209818 - RNA, 1758 nt, Artificial Sequence; identical to SEQ ID NO: 209538
  derived and/or modified sequence opt5 from hemagglutinin__InfluenzaB__AFJ80836

SEQ ID NO: 209819 - RNA, 1758 nt, Artificial Sequence; identical to SEQ ID NO: 209606
  derived and/or modified sequence opt5 from hemagglutinin__InfluenzaB__AFJ80847

SEQ ID NO: 209820 - RNA, 1758 nt, Artificial Sequence; identical to SEQ ID NO: 209538
  derived and/or modified sequence opt5 from hemagglutinin__InfluenzaB__AFJ80858

SEQ ID NO: 209821 - RNA, 1758 nt, Artificial Sequence; identical to SEQ ID NO: 209538
  derived and/or modified sequence opt5 from hemagglutinin__InfluenzaB__AFJ80869

SEQ ID NO: 209822 - RNA, 1758 nt, Artificial Sequence; identical to SEQ ID NO: 209538
  derived and/or modified sequence opt5 from hemagglutinin__InfluenzaB__AFJ80880

SEQ ID NO: 209823 - RNA, 1758 nt, Artificial Sequence; identical to SEQ ID NO: 209589
  derived and/or modified sequence opt5 from hemagglutinin__InfluenzaB__AFJ80891

SEQ ID NO: 209824 - RNA, 1758 nt, Artificial Sequence; identical to SEQ ID NO: 209589
  derived and/or modified sequence opt5 from hemagglutinin__InfluenzaB__AFJ80902

SEQ ID NO: 209825 - RNA, 1758 nt, Artificial Sequence; identical to SEQ ID NO: 209538
  derived and/or modified sequence opt5 from hemagglutinin__InfluenzaB__AFJ80913

SEQ ID NO: 209826 - RNA, 1758 nt, Artificial Sequence
  derived and/or modified sequence opt5 from hemagglutinin__InfluenzaB__AFJ80924
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucugugccgagggagaggaucagauuacggucuggggcuuccacucugacaacgaaacccagauggcuaaacuuuauggggauuccaagccccagaaguuuacaagcucugccaauggaguuaccacacacuacgugucccaaaucggcggcuucccgaaccagaccgaggacgggggacugccucagagcggcagaaucguggucgauuauauggugcagaagucugggaaaacgggaacaauuaccuaccaacggggcauccuccugccccagaagguuuggugcgcuuccgggcgcagcaaagugauuaagggaucccuuccucugaucggcgaagccgacugucuccaugagaaauauggcgggcugaauaagucuaaacccuacuacaccggagagcacgcgaaggccauuggcaacugccccaucugggucaagacaccucugaaacucgcuaaugggaccaaguauagaccgcccgccaaacugcuuaaggaacggggauuuuucggcgcuaucgccggguuucuggagggcggaugggaaggcaugauugccggguggcauggauacacaagccacggcgcucacgggguggcgguugccgcugaucucaaauccacgcaggaggccaucaacaagauuaccaagaaucugaacagccuuucugaacuggaggugaaaaaucuccagcgccuguccggagccauggacgagcugcauaacgaaauccucgagcuggaugaaaaggucgacgaccuuagagcugauacaauuagcucucaaaucgagcuggccgugcuccugagcaaugaaggcaucauuaacuccgaggacgagcaccuucuggcgcucgaacggaaacugaagaaaaugcuggggccuucugcugucgagaucggcaauggauguuucgaaaccaagcauaagugcaaccagacaugccucgaucgcauugccgccggcaccuuugacgcuggggaguucagccugcccacguuugauucccuuaauaucaccgccgcuagccugaacgacgauggacucgacaaccacacaauucugcuguauuacucuaccgccgcguccagccuugccgugacacucaugaucgcuauuuucguuguguauauggucucuagagauaauguguccuguagcaucugccuguga

SEQ ID NO: 209827 - RNA, 1758 nt, Artificial Sequence; identical to SEQ ID NO: 209589
  derived and/or modified sequence opt5 from hemagglutinin__InfluenzaB__AFJ80935

SEQ ID NO: 209828 - RNA, 1755 nt, Artificial Sequence; identical to SEQ ID NO: 209450
  derived and/or modified sequence opt5 from hemagglutinin__InfluenzaB__AFJ80946

SEQ ID NO: 209829 - RNA, 1758 nt, Artificial Sequence
  derived and/or modified sequence opt5 from hemagglutinin__InfluenzaB__AFJ80957
augaaggccaucauugugcugcucauggucgcuaccagcaacgccgacagaaucugcacaggcauuacguccucuaauagcccccacguugugaaaaccgcgacacagggggaggugaacgucaccggagugaucccucugacaaccacaccgaccaagucccauuucgcuaaucuuaaaggcacggaaacccgggggaagcugugucccaaaugccucaacuguacagaucuggacguugcccuuggacgcccuaagugcaccggcaauauucccucugccagagugagcauccugcacgagguccggccugugacauccggguguuuucccaucaugcaugaucgcaccaagauuagacaacucccuaaccugcugcggggauacgaacacauccgccucucuacgcauaauguuauuaacgcugagaaugccccgggcggccccuauaaaaucgggacaagcggauccugcccuaacgugaccaauggcaacggguucuuugcuacaauggccugggcgguccccaagaaugacaacaauaaaaccgccaccaacagccugacaauugaagugccuuacaucuguacggagggagaggaucagauuaccguguggggcuuccacucugacaacgaaacacagauggcuaaacuuuauggggauuccaagccccagaaguuuaccagcucugccaauggagucacaacccacuacguuucccaaaucggcggcuucccgaaccagacggaggacgggggacugccucagagcggcagaaucgugguggauuauaugguccagaagucugggaaaacaggaaccauuaccuaccaacggggcauccuccugccccagaagguguggugcgcuuccgggcgcagcaaaguuauuaagggaucccuuccucugaucggcgaagccgacugucuccaugagaaauauggcgggcugaauaagucuaaacccuacuacacaggagagcacgcgaaggccauuggcaacugccccaucugggugaagaccccucugaaacucgcuaaugggacaaaguauagaccgcccgccaaacugcuuaaggaacggggauuuuucggcgcuaucgccggguuucuggagggcggaugggaaggcaugauugccggguggcauggauacacgagccacggcgcucacggggucgcgguggccgcugaucucaaauccacccaggaggccaucaacaagauuacaaagaaucugaacagccuuucugaacuggagguuaaaaaucuccagcgccuguccggagccauggacgagcugcauaacgaaauccucgagcuggaugaaaagguggacgaccuuagagcugauaccauuagcucucaaaucgagcuggccguccuccugagcaaugaaggcaucauuaacuccgaggacgagcaccuucuggcgcucgaacggaaacugaagaaaaugcuggggccuucugcuguggagaucggcaauggauguuucgaaacaaagcauaagugcaaccagaccugccucgaucgcauugccgccggcacguuuaaugcuggggaguucagccugcccaccuuugacucccuuaacaucacagccgcuagccugaacgaugacggacucgauaaucacaccauucugcuguauuacucuacagccgcguccagccuugccgucacccucaugaucgcuauuuucgugguuuauauggugucuagagacaacgucuccuguagcaucugccuguga

SEQ ID NO: 209830 - RNA, 1755 nt, Artificial Sequence; identical to SEQ ID NO: 209450
  derived and/or modified sequence opt5 from hemagglutinin__InfluenzaB__AFJ80968

SEQ ID NO: 209831 - RNA, 1755 nt, Artificial Sequence; identical to SEQ ID NO: 209450
  derived and/or modified sequence opt5 from hemagglutinin__InfluenzaB__AFJ80979

SEQ ID NO: 209832 - RNA, 1755 nt, Artificial Sequence
  derived and/or modified sequence opt5 from hemagglutinin__InfluenzaB__AFJ80990
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccgaagccagcauucugcaugaggugcggccuguuaccuccggguguuuucccaucaugcacgaccgcacgaaaaucagacaacucccuaaucugcugcggggauaugaaaacauucgccucucuacacagaaugugaucgaugcugagaaggccccgggcggccccuacagacuggggaccagcggauccugcccuaacgcuacaaauaagagcggcuucuuugccaccauggcgugggccguccccaaagacaacaauaagaacgcuaccaauccucuuacaguggaagugcccuauauuuguacggagggggaggaucagaucaccgucuggggauuccauucugacaacaaaacacagaugaagaaucuguacggcgauuccaacccgcaaaaauuuaccagcucugccaacgggguuacaacccacuaugugucccagauuggaggcuucccugaccagacggaagauggcgggcucccccagagcggacggaucguggucgacuacaugaugcaaaagccuggcaagacagggaccauuguguaucagcgcggaguucugcuuccccagaaaguguggugcgcuucuggcagauccaaggucaucaaagggagccugccccucaucggagaggccgauugucugcaugaaaaguacggcggccugaauaaauccaagccuuacuauaccggggagcacgcgaaagccauuggaaacugcccgaucugggugaagacaccccucaagcuggcuaauggcaccaaauaccggccucccgccaagcugcugaaagagcgcggguuuuucggagcuauugccggcuuucucgaagggggcugggagggaaugaucgccggcuggcacggguauacaucucauggagcucacggcguugcgguggccgcugaccuuaagagcacgcaggaagccauuaacaaaaucaccaagaaucuuaacucccugagcgagcucgaagucaagaaucugcaaagacugucuggggccauggacgagcuccauaacgagauccuggaacuugaugagaaaguggacgaucugcgggcugacacaauuuccagccagaucgaacucgccguccugcuuucuaaugagggaauuaucaacagcgaagaugagcaucugcucgcgcuggagcgcaagcugaaaaagaugcucggcccuuccgcuguggacauugggaauggcuguuucgaaaccaaacacaagugcaaccagacaugccuggauagaaucgccgccggaaccuuuaaugcuggcgaguucucucuucccacguuugacagccugaacaucaccgccgcuucccucaaugaugacgggcuggauaaccacacaauucugcuuuacuauagcaccgccgcgucuucccucgccguuacacugaugcuggcuaucuucauuguguacauggucagccgggacaacgugucuuguuccaucugccucuga

SEQ ID NO: 209833 - RNA, 1755 nt, Artificial Sequence; identical to SEQ ID NO: 209450
  derived and/or modified sequence opt5 from hemagglutinin__InfluenzaB__AFJ81001

SEQ ID NO: 209834 - RNA, 1755 nt, Artificial Sequence; identical to SEQ ID NO: 209450
  derived and/or modified sequence opt5 from hemagglutinin__InfluenzaB__AFJ84360

SEQ ID NO: 209835 - RNA, 1758 nt, Artificial Sequence; identical to SEQ ID NO: 209538
  derived and/or modified sequence opt5 from hemagglutinin__InfluenzaB__AFJ90395

SEQ ID NO: 209836 - RNA, 1755 nt, Artificial Sequence; identical to SEQ ID NO: 209450
  derived and/or modified sequence opt5 from hemagglutinin__InfluenzaB__AFJ90406

SEQ ID NO: 209837 - RNA, 1755 nt, Artificial Sequence; identical to SEQ ID NO: 209450
  derived and/or modified sequence opt5 from hemagglutinin__InfluenzaB__AFJ90417

SEQ ID NO: 209838 - RNA, 1755 nt, Artificial Sequence; identical to SEQ ID NO: 209450
  derived and/or modified sequence opt5 from hemagglutinin__InfluenzaB__AFJ90428

SEQ ID NO: 209839 - RNA, 1755 nt, Artificial Sequence; identical to SEQ ID NO: 209450
  derived and/or modified sequence opt5 from hemagglutinin__InfluenzaB__AFJ90450

SEQ ID NO: 209840 - RNA, 1755 nt, Artificial Sequence; identical to SEQ ID NO: 209450
  derived and/or modified sequence opt5 from hemagglutinin__InfluenzaB__AFJ91038

SEQ ID NO: 209841 - RNA, 1755 nt, Artificial Sequence
  derived and/or modified sequence opt5 from hemagglutinin__InfluenzaB__AFJ91049
augaaggccaucauugugcugcucauggucguuaccagcaacgcugacagaaucugcacaggcauuacguccucuaauagcccccacguggugaaaaccgccacacagggggaggucaacgugaccggaguuaucccucugacaauuaccccgacaaaguccuacuucgcgaaucuuaaaggcacccggacgcgcgggaagcugugucccgauugccucaacuguaccgaccuggauguggcucuuggaagaccuaugugcgucggcacaacccccucugccaaagccagcauccugcaugaagugcggccuguuacauccggguguuuucccaucaugcacgaccgcaccaagauuagacaacucgcuaaucugcugcggggauaugagaacauccgccucucuacgcagaaugugauugaugccgaaaaggcuccuggcggcccguacagacuggggacaagcggauccugccccaacgccaccagcaaaucuggcuucuuugcgacaauggccugggcugucccuaaggacaauaacaaaaaugccaccaacccccuuaccguggaggugccuuauaucuguacagaaggggaggaucagauuacggucuggggauuccauuccgacaauaagacccagaugaaaaaccuguacggcgauagcaauccccaaaaguuuacaucuuccgcuaacgggguuaccacacacuaugugagccagaucggaggcuucccggaccagaccgaggauggcgggcucccucagucuggacggauuguggucgacuacaugaugcaaaagcccggcaaaacggggacaaucguguaucagcgcggaguucugcuuccucagaagguguggugcgccuccggcagaagcaaagucaucaaggggucccugccccucauuggagaagcggauugucugcaugagaaauacggcggccugaacaagucuaaacccuacuauaccggggaacacgccaaggcuaucggaaauugcccuauuugggugaagaccccgcucaaacuggccaacggcacaaaguaccggcccccugcuaaacuucugaaggagcgcggguuuuucggagccaucgccggcuuucucgaagggggcugggaaggaaugauugcuggcuggcacggguauaccagccauggagcgcacggcguugccguggcugccgaccugaaauccacacaggaggccaucaauaagaucacgaagaaccuuaauagccugucugaacucgaggucaaaaaccugcaaagacuguccggggcuauggacgaacuccauaaugagauucuggagcuugaugaaaagguggacgaucugcgggccgacaccaucagcucucagauugagcucgcgguccugcuuagcaacgaaggaaucauuaauuccgaggaugaacaucugcucgcucuggagcgcaaacugaagaaaaugcucggccccucugccguggacaucgggaacggcuguuucgagacaaagcacaagugcaaucagaccugccuggauagaaucgccgcuggaacauuuaacgccggcgaguucagccuuccuaccuuugacucccugaauauuacggcugccagccucaacgaugacgggcuggauaaucacaccauccugcuuuacuauucuacagcggccuccagccucgcuguuacccugaugcuggccauuuucaucguguacauggucucucgggacaacguguccuguagcauuugccucuga

SEQ ID NO: 209842 - RNA, 1758 nt, Artificial Sequence
  derived and/or modified sequence opt5 from hemagglutinin__InfluenzaB__AFJ91060
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcuguguccccgcugccucaacuguacagaucuggacguggcucuuggaagaccuaaaugcaccggcaauauucccucugcccgggucagcauccugcacgaggugcgcccuguuacauccggguguuuucccaucaugcaugauagaaccaagauucggcaacucccuaaccugcugcgcggauacgaacacaucagacucucuacgcauaaugugauuaacgccgagaaugcuccgggcggccccuauaagaucgggacaagcggauccugcccuaacgucaccaauggcaacggguucuuugccacaauggcuugggccgugcccaaaaaugacaacaauaagaccgcgaccaacagccugacaauugaagugccuuacaucuguacggagggagaggaucagauuaccgucuggggcuuccacucugacaacgaagcccagauggcuaaacuuuauggggauuccaagccccagaaauuuacaagcucugccaauggaguuaccacacacuacgugucccaaaucggcggcuucccgaaccagaccgaggacgggggacugccucagagcggccggaucguggucgauuauauggugcagaagucugggaagacgggaacaauuaccuaccaacgcggcauccuccugccccagaaaguuuggugcgcuuccgggagaagcaaggugauuaaaggaucccuuccucugaucggcgaagccgacugucuccaugagaaguauggcgggcugaauaaaucuaagcccuacuacaccggagagcacgcgaaagccauuggcaacugccccaucugggucaagacaccucugaagcucgcuaaugggaccaaauaucggccgcccgccaagcugcuuaaagaacgcggauuuuucggcgcuaucgccggguuucuggagggcggaugggaaggcaugauugccggguggcauggauacacaagccacggcgcucacgggguggcgguugccgcugaucucaaguccacgcaggaggccaucaacaaaauuaccaagaaucugaacagccuuucugaacuggaggugaagaaucuccagagacuguccggagccauggacgagcugcauaacgaaauccucgagcuggaugaaaaagucgacgaccuucgggcugauacaauuagcucucaaaucgagcuggccgugcuccugagcaaugaaggcaucauuaacuccgaggacgagcaccuucuggcgcucgaacgcaagcugaaaaagaugcuggggccuucugcugucgagaucggcaauggauguuucgaaaccaaacauaagugcaaccagacaugccucgauagaauugccgccggcaccuuugacgcuggggaguucagccugcccacguuugauucccuuaauaucaccgccgcuagccugaacgacgauggacucgacaaccacacaauucugcuguauuacucuaccgccgcguccagccuugccgugacacucaugaucgcuauuuucguuguguauauggucucucgggauaauguguccuguagcaucugccuguga

SEQ ID NO: 209843 - RNA, 1755 nt, Artificial Sequence; identical to SEQ ID NO: 209450
  derived and/or modified sequence opt5 from hemagglutinin__InfluenzaB__AFJ91071

SEQ ID NO: 209844 - RNA, 1755 nt, Artificial Sequence
  derived and/or modified sequence opt5 from hemagglutinin__InfluenzaB__AFJ91082
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaaagacugucuggcgccauggaugaacuccauaacgagauucuggagcuugacgaaaagguggaugaccugcgggcugauacaaucuccagccagauugagcucgccguccugcuuucuaaugaagggaucauuaacagcgaggacgaacaucugcucgcgcuggagcgcaaacugaagaaaaugcucggaccuuccgcuguggauaucggcaauggguguuucgagaccaagcacaagugcaaccagacaugccuggacagaaucgccgccggcaccuuuaaugcuggagaguucucucuucccacguuugauagccugaacauuaccgccgcuucccucaaugacgauggccuggacaaccacacaauccugcuuuauuacagcaccgccgcgucuucccucgccguuacacugaugcuggcuauuuucaucguguauauggucagccgggacaaugugucuuguuccauuugccucuga

SEQ ID NO: 209845 - RNA, 1755 nt, Artificial Sequence; identical to SEQ ID NO: 209844
  derived and/or modified sequence opt5 from hemagglutinin__InfluenzaB__AFJ91093

SEQ ID NO: 209846 - RNA, 1755 nt, Artificial Sequence; identical to SEQ ID NO: 209844
  derived and/or modified sequence opt5 from hemagglutinin__InfluenzaB__AFJ91104

SEQ ID NO: 209847 - RNA, 1755 nt, Artificial Sequence; identical to SEQ ID NO: 209844
  derived and/or modified sequence opt5 from hemagglutinin__InfluenzaB__AFJ91115

SEQ ID NO: 209848 - RNA, 1758 nt, Artificial Sequence
  derived and/or modified sequence opt5 from hemagglutinin__InfluenzaB__AFJ91704
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaagggguucuuugccacaauggcuugggccgugcccaaaaacgacaauaacaagaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaagcugacugucuccaugagaaguauggcgggcugaacaaaucuaagcccuacuacacaggagagcacgccaaggcgauuggcaauugccccaucugggucaaaaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgagccacggcgcccacgggguggcuguugcggccgaucucaaguccacccaggaggcuaucaauaagauuaccaaaaaccugaauagccuuucugaacuggaggugaagaaccuccagcgccuguccggagccauggacgagcugcauaaugaaauccucgagcuggaugaaaaagucgacgaccuuagagccgauacaauuagcucucaaaucgagcuggcugugcuccugagcaacgaaggcaucauuaauuccgaggacgagcaccuucuggcccucgaacggaagcugaaaaagaugcuggggccuucugcggucgagaucggcaacggauguuucgaaacaaagcauaaaugcaaucagaccugccucgaucgcauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucuagagauaacguguccuguagcaucugccuguga

SEQ ID NO: 209849 - RNA, 1755 nt, Artificial Sequence
  derived and/or modified sequence opt5 from hemagglutinin__InfluenzaB__AFK09797
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgauuaaguccuacuucgcgaaucuuaaaggcaccaagacgcgggggaaacugugucccgauugccucaacuguaccgaccuggauguggcucuuggacgcccuaugugcgucggcacaacccccucugccaaggccagcauccugcaugaagugagaccuguuacauccggguguuuucccaucaugcacgaccggaccaagauucgccaacucccuaaucugcugagaggauaugagaacauccggcucucuacgcagaaugugauugaugcugaaaaagccccgggcggccccuaccgccuggggacaagcggauccugcccuaacgcuaccagcaagucuggcuucuuugccacaauggcgugggccguccccaaagacaauaacaagaaugcuaccaacccucuuaccguggaggugcccuaugucuguacagaaggggaggaucagaucacgguuuggggauuccauuccgacaauaaaaaccagaugaagaaucuguacggcgauagcaacccgcaaaaguuuaccucuuccgccaacggggugacaacccacuaugugagccagauuggaggcuucccugaccagacagaggauggcgggcucccccagucuggaagaaucgucguggacuacaugguucaaaaaccuggcaagaccgggacgauuguguaucagcggggaguccugcuuccccagaaaguguggugcgcuuccggccgcagcaagguuaucaaagggucccugccccucaucggagaagccgauugucugcaugagaaguacggcggccugaauaaaucuaagccuuacuauacaggggaacacgcgaaggccauuggaaacugcccgaucugggugaaaacaccccucaagcuggcuaauggcaccaaauacagaccucccgccaagcugcugaaagagcggggguuuuucggagcuauugccggcuuucucgaagggggcugggaaggaaugaucgccggcuggcacggguauacaagccauggagcucacggcgucgcgguggccgcugaccugaaguccacccaggaggccauuaacaagaucaccaaaaaucuuaacagccugucugaacucgaggucaagaaucugcaacgccuguccggggccauggacgaacuccauaacgagauccuggagcuugaugaaaaaguggacgaucugagagcugacacgauuagcucucagaucgagcucgccguucugcuuagcaaugaaggaauuaucaacuccgaggaugaacaccuucucgcgcuggagcggaagcugaaaaagaugcucggcccuucugcuguggacauugggaauggcuguuucgagaccaagcacaaaugcaaccagacaugccuggaucgcaucgccgccggaaccuuuaaugcuggcgaguucagccuucccacauuugacucccugaacaucaccgccgcuagccucaaugaugacgggcuggauaaccauacgauucugcuuuacuauucuaccgccgcguccagccucgccgucacacugaugcuggcuaucuucauuguguacaugguuucuagagacaacguguccuguagcaucugccucuga

SEQ ID NO: 209850 - RNA, 1755 nt, Artificial Sequence; identical to SEQ ID NO: 209844
  derived and/or modified sequence opt5 from hemagglutinin__InfluenzaB__AFN54654

SEQ ID NO: 209851 - RNA, 1755 nt, Artificial Sequence; identical to SEQ ID NO: 209591
  derived and/or modified sequence opt5 from hemagglutinin__InfluenzaB__AFN54665

SEQ ID NO: 209852 - RNA, 1755 nt, Artificial Sequence; identical to SEQ ID NO: 209591
  derived and/or modified sequence opt5 from hemagglutinin__InfluenzaB__AFN54676

SEQ ID NO: 209853 - RNA, 1755 nt, Artificial Sequence; identical to SEQ ID NO: 209844
  derived and/or modified sequence opt5 from hemagglutinin__InfluenzaB__AFN54687

SEQ ID NO: 209854 - RNA, 1755 nt, Artificial Sequence
  derived and/or modified sequence opt5 from hemagglutinin__InfluenzaB__AFN54698
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcuucgccaaugggguuacaacccacuacgugucucagaucggagacuuuccugaucagacggaggacggcggccucccccaguccgggcggauuguggucgauuauaugaugcaaaagccuggaaaaacaggcaccaucguguaccagcgcgggguucugcuuccccagaagguguggugcgcuagcggaagaucuaaagucaucaagggcucccugccccucauuggggaagccgacugucugcaugagaaauacggaggccugaacaagagcaaaccuuauuacaccggcgaacacgcgaaggccaucgggaacugcccgauuugggugaagacaccccucaaacuggcuaauggaaccaaguaucggccucccgccaaacuucugaaggagcgcggcuucuuuggggcuaucgccggauuccucgagggcgggugggaaggcaugauugccggauggcacggcuacacaucccauggggcucacggaguugcgguggccgcugaccugaaaucuacgcaggaggccaucaacaagaucaccaagaaucuuaacagccuguccgaacucgaggucaaaaaucugcaaagacugagcggcgccauggaugaacuccauaacgagauucuggagcuugacgaaaagguggaugaccugcgggcugauacaaucucuucccagauugagcucgccguccugcuuagcaaugaagggaucauuaacucugaggacgaacaucugcucgcgcuggagcgcaaacugaagaaaaugcucggaccuagcgcuguggauaucggcaauggguguuuugagaccaagcacaagugcaaccagacaugccuggacagaaucgccgccggcaccuucaaugcuggagaauuuucccuucccacguucgauucucugaacauuaccgccgcuagccucaaugacgauggccuggacaaccacacaauccugcuuuauuacuccaccgccgcgagcucucucgccguuacacugaugcuggcuauuuucaucguguauauggucucccgggacaaugugagcuguucuauuugccucuga

SEQ ID NO: 209855 - RNA, 1755 nt, Artificial Sequence; identical to SEQ ID NO: 209844
  derived and/or modified sequence opt5 from hemagglutinin__InfluenzaB__AFN54709

SEQ ID NO: 209856 - RNA, 1755 nt, Artificial Sequence; identical to SEQ ID NO: 209844
  derived and/or modified sequence opt5 from hemagglutinin__InfluenzaB__AFN54720

SEQ ID NO: 209857 - RNA, 1755 nt, Artificial Sequence; identical to SEQ ID NO: 209844
  derived and/or modified sequence opt5 from hemagglutinin__InfluenzaB__AFN54731

SEQ ID NO: 209858 - RNA, 1755 nt, Artificial Sequence; identical to SEQ ID NO: 209844
  derived and/or modified sequence opt5 from hemagglutinin__InfluenzaB__AFN54742

SEQ ID NO: 209859 - RNA, 1755 nt, Artificial Sequence; identical to SEQ ID NO: 209844
  derived and/or modified sequence opt5 from hemagglutinin__InfluenzaB__AFN54753

SEQ ID NO: 209860 - RNA, 1755 nt, Artificial Sequence; identical to SEQ ID NO: 209844
  derived and/or modified sequence opt5 from hemagglutinin__InfluenzaB__AFN54764

SEQ ID NO: 209861 - RNA, 1755 nt, Artificial Sequence; identical to SEQ ID NO: 209844
  derived and/or modified sequence opt5 from hemagglutinin__InfluenzaB__AFN54775

SEQ ID NO: 209862 - RNA, 1755 nt, Artificial Sequence; identical to SEQ ID NO: 209844
  derived and/or modified sequence opt5 from hemagglutinin__InfluenzaB__AFN54786

SEQ ID NO: 209863 - RNA, 1755 nt, Artificial Sequence; identical to SEQ ID NO: 209844
  derived and/or modified sequence opt5 from hemagglutinin__InfluenzaB__AFN54797

SEQ ID NO: 209864 - RNA, 1755 nt, Artificial Sequence; identical to SEQ ID NO: 209844
  derived and/or modified sequence opt5 from hemagglutinin__InfluenzaB__AFN54808

SEQ ID NO: 209865 - RNA, 1755 nt, Artificial Sequence; identical to SEQ ID NO: 209591
  derived and/or modified sequence opt5 from hemagglutinin__InfluenzaB__AFN54819

SEQ ID NO: 209866 - RNA, 1755 nt, Artificial Sequence; identical to SEQ ID NO: 209844
  derived and/or modified sequence opt5 from hemagglutinin__InfluenzaB__AFN54830

SEQ ID NO: 209867 - RNA, 1755 nt, Artificial Sequence; identical to SEQ ID NO: 209844
  derived and/or modified sequence opt5 from hemagglutinin__InfluenzaB__AFN54841

SEQ ID NO: 209868 - RNA, 1755 nt, Artificial Sequence; identical to SEQ ID NO: 209844
  derived and/or modified sequence opt5 from hemagglutinin__InfluenzaB__AFN54852

SEQ ID NO: 209869 - RNA, 1755 nt, Artificial Sequence; identical to SEQ ID NO: 209844
  derived and/or modified sequence opt5 from hemagglutinin__InfluenzaB__AFN54863

SEQ ID NO: 209870 - RNA, 1758 nt, Artificial Sequence
  derived and/or modified sequence opt5 from hemagglutinin__InfluenzaB__AFU34595
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauagagauucuaagccucagaaauuuaccuccagcgcuaacgggguuacaacccacuacgugucucaaaucggaggcuuccccaaccagacggaggacggcgggcuuccucaguccggacggaucguggucgauuauauggugcaaaagagcggcaaaacagggaccauuaccuaccagcgcggaauccugcucccccagaagguuuggugcgccucuggcagauccaaagugauuaaggggagccugccccuuaucggagaagcugacugucugcaugagaaauauggcggccucaauaaguccaagccuuacuacacaggggagcacgccaaagcgauuggaaacugcccgaucugggucaagacaccccugaaacuggccaauggcaccaaguaucggccucccacgaaacuccugaaggaacgcggguuuuucggagcuaucgccggcuuucuugaagggggcugggagggaaugauugcuggcuggcauggguacaccucucacggagcccacggcguggccguugcugcggaucucaagagcacacaggaggccaucaacaaaauuaccaagaaucugaacucccugagcgaacuugaggugaaaaaucugcagagacucucuggggcuauggacgagcugcauaacgaaauccuggagcucgaugaaaaggucgacgaccugcgggccgauacaauuuccagccaaaucgagcuugccgugcugcucucuaaugaaggaaucauuaacagcgaggacgagcaucugcuugcucuggaacgcaaacucaagaagaugcugggcccuuccgccgucgagaucgggaauggcuguuucgaaaccaaacacaagugcaaccagacgugccuggauagaauugcggcuggaaccuuugacgccggcgaguucucucuccccacauuugauagccugaauaucaccgccgcuucccuuaacgacgaugggcuggacaaucacacaauucuccuguauuacagcaccgccgcuucuucccuggccgugacgcuuaugaucgcgauuuucguuguguauauggucagccgggauaacgugucuuguuccaucugccucuga

SEQ ID NO: 209871 - RNA, 1758 nt, Artificial Sequence
  derived and/or modified sequence opt5 from hemagglutinin__InfluenzaB__AFU34606
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucuggaucgccccaagugcaccggaaagauuccuucugccagagucagcauccuucacgaggugcggcugguuacauccggcuguuuucccaucaugcaugaccgcaccaaaauuagacaacucccuaaucugcugcggggguacgaacacauccgccucucuacgcauaacgugauuaaugccgagaacgcuccgggaggccccuauaagaucggcacaagcggguccugcccuaaugucaccaacggaaauggcuucuuugccacaauggcuugggccgugcccaaaaacgauaagaauaaaaccgcgaccaacccucugacaauugaagugcccuacaucuguacggagggggaggaccagauuaccgucuggggauuccacagcgaugacgaaacacagauggccaagcuguauggcgauucuaagccgcagaaauuuaccuccagcgcuaaugggguuacaacccacuacgugucucaaaucggaggcuucccuaaccagacggaggacggcgggcugccccaguccggaagaaucguggucgauuauauggugcaaaagagcggcaaaacagggaccauuaccuaccagcggggaauccuccugccucagaagguuuggugcgccucuggccgcuccaaagugauuaaggggagccuuccccugaucggagaagcugacugucuccaugagaaauauggcggccugaacaaguccaagcccuacuacacaggggagcacgccaaagcgauuggaaauugcccuaucugggucaagaccccgcugaaacucgccaacggcacaaaguauagacccccugcuaaacugcuuaaggaacggggguuuuucggagccaucgcuggcuuucuggaagggggcugggagggaaugauugccggcuggcauggguacacgucucacggagcccacggcguggcuguugcggccgaucucaagagcacccaggaggcuaucaauaaaauuacaaagaaccuuaauucccuuagcgaacuggaggugaaaaaccuccagcgccugucuggggccauggacgagcugcauaaugaaauccucgagcuggacgaaaaggucgaugaccuuagagccgauaccauuuccagccaaaucgagcuggcugugcuccugucuaacgaaggaaucauuaauagcgaggacgagcaccuucuggcccucgaacggaaacugaagaagaugcugggccccuccgcggucgagaucgggaacggcuguuucgaaacaaaacauaagugcaaucagaccugccucgaucgcauugcugccggaacguuugacgccggcgaguucucucugccuaccuuugauagccuuaacaucacagcugccucccugaaugacgaugggcucgacaaccacaccauucugcuguauuacagcacagcugccucuucccuugcggugacccucaugaucgccauuuucguuguguauauggucagcagagauaaugugucuuguuccaucugccuguga

SEQ ID NO: 209872 - RNA, 1758 nt, Artificial Sequence; identical to SEQ ID NO: 209780
  derived and/or modified sequence opt5 from hemagglutinin__InfluenzaB__AFU34617

SEQ ID NO: 209873 - RNA, 1758 nt, Artificial Sequence
  derived and/or modified sequence opt5 from hemagglutinin__InfluenzaB__AFU34628
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacgaugaaacacagauggccaagcuguauggggacucuaagccucagaaauuuaccuccagcgcuaauggaguuacaacccacuacgugucucaaaucggcggcuuccccaaccagacggaggaugggggacuuccucaguccggcagaaucguggucgacuauauggugcagaaguccgggaaaacaggaaccauuaccuaccaacggggcauccugcucccccagaagguuuggugcgccucugggcgcuccaaagugauuaagggaagccugccccuuaucggcgaagcugauugucugcaugagaaauauggcgggcucaacaaguccaagccuuacuacacaggagagcacgccaaagcgauuggcaauugcccgaucugggucaagacaccccugaaacuggccaacgggacaaaguauagaccucccgcuaaacuccugaaggaacggggauuucuuggcgccaucgcuggguuccuggagggcggauggaagggcaugauugccggguggcauggauacacgucucacggcgcccacgggguggcuguugcggccgaccucaaaagcacccaggaagcuaucaauaagauuaccaaaaaccugaauagccuuagcgagcuggaagugaagaaccuccagcgccugucuggagccauggaugagcugcauaaugagauccucgaacuggacgagaaagucgacgaucuuagagccgacaccauuuccagccaaaucgaacuggcugugcuccugucuaacgagggcaucauuaauagcgaagaugagcaccuucuggcccucgagcggaagcugaagaaaaugcuggggccuuccgcggucgaaaucggcaacggauguuuugagacaaagcauaaaugcaaucagaccugccucgaccgcauugcugccggcacguucgaugccggggaauuuucucugcccaccuucgacagccuuaacaucacagcugccucccugaaugaugacggacucgauaaccacaccauucugcuguauuacagcacagcugccucuucccuugcggugacccucaugaucgccauuuuuguuguguauauggucagcagagacaaugugucuuguuccaucugccuguga

SEQ ID NO: 209874 - RNA, 1758 nt, Artificial Sequence; identical to SEQ ID NO: 209632
  derived and/or modified sequence opt5 from hemagglutinin__InfluenzaB__AFU34639

SEQ ID NO: 209875 - RNA, 1758 nt, Artificial Sequence; identical to SEQ ID NO: 209669
  derived and/or modified sequence opt5 from hemagglutinin__InfluenzaB__AGB08299

SEQ ID NO: 209876 - RNA, 1758 nt, Artificial Sequence; identical to SEQ ID NO: 209669
  derived and/or modified sequence opt5 from hemagglutinin__InfluenzaB__AGB08300

SEQ ID NO: 209877 - RNA, 1755 nt, Artificial Sequence
  derived and/or modified sequence opt5 from hemagglutinin__InfluenzaB__AGB97259
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaauaaaacacagaugaagucccuguauggcgauagcaacccgcaaaaguuuaccucuuccgccaaugggguuacaacccacuacgugagccagaucggagacuucccugaucagacggaggacggcggccucccccagucugggcggauuguggucgauuauaugaugcaaaaaccuggaaagacaggcaccaucguguaccagcgcgggguucugcuuccccagaaaguguggugcgcuuccggaagaagcaaggucaucaaaggcucccugccccucauuggggaagccgacugucugcaugaggaauacggaggccugaacaagucuaaaccuuauuacaccggcaagcacgcgaaggccaucgggaauugcccgauuugggugaaaacaccccucaagcuggcuaacggaaccaaauaucggccucccgccaagcugcugaaagagcgcggcuuuuucggggcuaucgccggauuucucgagggcgggugggaaggcaugauugccggauggcacggcuacacaagccauggggcucacggaguugcgguggccgcugaccugaaguccacgcaggaggccaucaacaagaucaccaaaaaucuuaacagccugucugaacucgaggucaagaaucugcaaagacuguccggcgccauggaugaacuccauaacgagauucuggagcuugacgaaaaaguggaugaccugcgggcugauacaaucagcucucagauugagcucgccguccugcuuagcaaugaagggaucauuaacuccgaggacgaacaccuucucgcgcuggagcgcaagcugaaaaagaugcucggaccuucugcuguggauaucggcaauggguguuucgagaccaagcacaaaugcaaccagacaugccuggacagaaucgccgccggcaccuuuaaugcuggagaguucagccuucccacguuugauucccugaacauuaccgccgcuagccucaaugacgauggccuggacaaccauacaauccugcuuuauuacucuaccgccgcguccagccucgccguuacacugaugcuggcuauuuucaucguguauauugucucucgggacaauguguccuguagcaucugccucuga

SEQ ID NO: 209878 - RNA, 1755 nt, Artificial Sequence
  derived and/or modified sequence opt5 from hemagglutinin__InfluenzaB__AGB97265
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugaucgcgggcuggcacggguauaccagccauggagcccacggcguugcuguggccgccgaccugaaguccacacaggaggcuauuaauaagaucacgaaaaaccuuaauagccugucugaacucgaggucaagaaccugcaacgccuguccggggccauggacgaacuccauaaugagauccuggagcuugaugaaaaaguggacgaucugagagcggacaccauuagcucucagaucgagcucgcuguccugcuuagcaacgaaggaauuaucaauuccgaggaugaacaccuucucgcccuggagcggaagcugaaaaagaugcucggccccucugccguggacauugggaacggcuguuucgagacaaagcacaaaugcaaucagaccugccuggaucgcaucgcugccggaacauuuaacgcuggcgaguucagccuuccuaccuuugacucccugaauaucacggccgcgagccucaacgaugacgggcuggauaaucauaccauucugcuuuacuauucuacagccgcuuccagccucgccguuacccugaugcuggcuaucuucauuguguacauggucucuagagacaacguguccuguagcaucugccucuga

SEQ ID NO: 209879 - RNA, 1755 nt, Artificial Sequence; identical to SEQ ID NO: 209878
  derived and/or modified sequence opt5 from hemagglutinin__InfluenzaB__AGF44878

SEQ ID NO: 209880 - RNA, 1755 nt, Artificial Sequence; identical to SEQ ID NO: 209878
  derived and/or modified sequence opt5 from hemagglutinin__InfluenzaB__AGF44879

SEQ ID NO: 209881 - RNA, 1755 nt, Artificial Sequence
  derived and/or modified sequence opt5 from hemagglutinin__InfluenzaB__AGF44881
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccgucuggggauuccauuccgacaauaaaacgcagaugaagaaccuguacggcgauagcaauccccaaaaguuuaccucuuccgcgaacgggguuacaacccacuaugugagccagauuggaggcuucccggaccagacagaggauggcgggcucccucagucuggaagaaucguggucgacuacaugaugcaaaaacccggcaagaccgggacgauuguguaucagcggggaguucugcuuccucagaaaguguggugcgccuccggccgcagcaaggucaucaaagggucccugccccucaucggagaagcugauugucugcaugagaaguacggcggccugaacaaaucuaagcccuacuauacaggggaacacgccaaggcuauuggaaauugcccuaucugggugaaaaccccgcucaagcuggccaacggcaccaaauacagacccccugccaaacuucugaaagagcggggguuuuucggagcuauugcgggcuuucucgaagggggcugggaaggaaugaucgccggcuggcacggguauacaagccauggagcucacggcguugccguggccgcugaccugaaguccacccaggaggccauuaauaagaucacaaagaaccuuaauagccugucugaacucgaggucaagaaccugcaacgccuguccggggcgauggacgaacuccauaaugagauccuggagcuugaugaaaaaguggacgaucugagagcugacacgauuagcucucagaucgagcucgccguccugcuuagcaacgaaggaauuaucaauuccgaggaugaacaucugcucgcccuggagcggaagcugaaaaagaugcucggccccucugcuguggacauugggaacggcuguuucgagaccaagcacaaaugcaaucagacaugccuggaucgcaucgccgcuggaaccuuuaacgccggcgaguucagccuuccuacauuugacucccugaauaucaccgcggccagccucaacgaugacgggcuggauaaucacacgauucugcuuuacuauucuaccgcugccuccagccucgcuguuauccugaugcuggccauuuucaucguguacauggucucuagagacaacguguccuguagcauuugccucuga

SEQ ID NO: 209882 - RNA, 1755 nt, Artificial Sequence
  derived and/or modified sequence opt5 from hemagglutinin__InfluenzaB__AGF44882
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggcaagagcaaagucaucaaggggucccugccccucaucggagaagccgauugucugcaugagaaauacggcggccugaacaagucuaagcccuacuauaccggggaacacgcuaaagccauuggaaauugcccuaucugggugaagaccccgcucaaacuggcuaacggcacaaaguacagacccccugccaaacuucugaaggagcgcggguuuuucggagccauugcuggcuuucucgaagggggcugggaaggaaugaucgcgggcuggcacggguauaccagccauggagcccacggcguugcuguggccgccgaccugaaguccacacaggaggcuauuaauaaaaucacgaagaaccuuaauagccugucugaacucgaggucaaaaaccugcaacggcuguccggggccauggacgaacuccauaaugagauccuggagcuugaugaaaagguggacgaucugcgcgcggacaccauuagcucucagaucgagcucgcuguccugcuuagcaacgaaggaauuaucaauuccgaggaugaacaucugcucgcccuggagagaaaacugaagaagaugcucggccccucugccguggacauugggaacggcuguuucgagacaaaacacaagugcaaucagaccugccuggaucggaucgcugccggaacauuuaacgcuggcgaguucagccuuccuaccuuugacucccugaauaucacggccgcgagccucaacgaugacgggcuggauaaucacaccauucugcuuuacuauucuacagccgcuuccagccucgccguuacccugaugcuggcuaucuucauuguguacauggucucucgcgacaacguguccuguagcaucugccucuga

SEQ ID NO: 209883 - RNA, 1755 nt, Artificial Sequence; identical to SEQ ID NO: 209878
  derived and/or modified sequence opt5 from hemagglutinin__InfluenzaB__AGF44883

SEQ ID NO: 209884 - RNA, 1755 nt, Artificial Sequence; identical to SEQ ID NO: 209878
  derived and/or modified sequence opt5 from hemagglutinin__InfluenzaB__AGF44884

SEQ ID NO: 209885 - RNA, 1755 nt, Artificial Sequence; identical to SEQ ID NO: 209878
  derived and/or modified sequence opt5 from hemagglutinin__InfluenzaB__AGF44886

SEQ ID NO: 209886 - RNA, 1755 nt, Artificial Sequence; identical to SEQ ID NO: 209878
  derived and/or modified sequence opt5 from hemagglutinin__InfluenzaB__AGF44887

SEQ ID NO: 209887 - RNA, 1755 nt, Artificial Sequence; identical to SEQ ID NO: 209878
  derived and/or modified sequence opt5 from hemagglutinin__InfluenzaB__AGF44888

SEQ ID NO: 209888 - RNA, 1755 nt, Artificial Sequence
  derived and/or modified sequence opt5 from hemagglutinin__InfluenzaB__AGL09834
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccgucuggggauuccauuccgacaauaaaacgcagaugaagaaccuguacggcgauagcaauccccaaaaguuuaccucuuccgcgaacgggguuacaacccacuaugugagccagauuggaggcuucccggaccagacagaggauggcgggcucccucagucuggaagaaucguggucgacuacaugaugcaaaaacccggcaagaccgggacgauuguguaucagcggggaguucugcuuccucagaaaguguggugcgccuccggccgcagcaaggucaucaaagggucccugccccucaucggagaagcugauugucugcaugagaaguacggcggccugaacaaaucuaagcccuacuauacaggggaacacgccaaggcuauuggaaauugcccuaucugggugaaaaccccgcucaagcuggccaacggcaccaaauacagacccccugccaaacuucugaaagagcggggguuuuucggagcuauugcgggcuuucucgaagggggcugggagggaaugaucgccggcuggcacggguauacaagccauggagcucacggcguugccguggccgcugaccugaaguccacccaggaggccauuaauaagaucacaaagaaccuuaauagccugucugaacucgaggucaagaaccugcaacgccuguccggggcgauggacgaacuccauaaugagauccuggagcuugaugaaaaaguggacgaucugagagcugacacgauuagcucucagaucgagcucgccguccugcuuagcaacgaaggaauuaucaauuccgaggaugaacaucugcucgcccuggagcggaagcugaaaaagaugcucggccccucugcuguggacauugggaacggcuguuucgagaccaagcacaaaugcaaucagacaugccuggaucgcaucgccgcuggaaccuuuaacgccggcgacuucagccuuccuacauuugauucccugaauaucaccgcggccagccucaacgacgaugggcuggacaaucacacgauucugcuuuacuauucuaccgcugccuccagccucgcuguuacacugaugcuggccaucuucauuguguacauggucucuagagacaacguguccuguagcaucugccucuga

SEQ ID NO: 209889 - RNA, 1755 nt, Artificial Sequence; identical to SEQ ID NO: 209878
  derived and/or modified sequence opt5 from hemagglutinin__InfluenzaB__AGL09835

SEQ ID NO: 209890 - RNA, 1755 nt, Artificial Sequence
  derived and/or modified sequence opt5 from hemagglutinin__InfluenzaB__AGL09836
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccaaaaaggcuccuggcggcccguaccgccuggggaccagcggauccugccccaacgccacaagcaaaucuggcuucuuugcgaccauggccugggcugucccugaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugaucgcgggcuggcacggguauaccagccauggagcccacggcguugcuguggccgccgaccugaaguccacacaggaggcuauuaauaagaucacgaaaaaccuuaauagccugucugaacucgaggucaagaaccugcaacgccuguccggggccauggacgaacuccauaaugagauccuggagcuugaugaaaaaguggacgaucugagagcggacaccauuagcucucagaucgagcucgcuguccugcuuagcaacgaaggaauuaucaauuccgaggaugaacaccuucucgcccuggagcggaagcugaaaaagaugcucggccccucugccguggacauugggaacggcuguuucgagacaaagcacaaaugcaaucagaccugccuggaucgcaucgcugccggaacauuuaacgcuggcgaguucagccuuccuaccuuugacucccugaauaucacggccgcgagccucaacgaugacgggcuggauaaucauaccauucugcuuuacuauucuacagccgcuuccagccucgccguuacccugaugcuggcuaucuucauuguguacauggucucuagagacaacguguccuguagcaucugccucuga

SEQ ID NO: 209891 - RNA, 1755 nt, Artificial Sequence; identical to SEQ ID NO: 209878
  derived and/or modified sequence opt5 from hemagglutinin__InfluenzaB__AGL09837

SEQ ID NO: 209892 - RNA, 1755 nt, Artificial Sequence; identical to SEQ ID NO: 209878
  derived and/or modified sequence opt5 from hemagglutinin__InfluenzaB__AGL09838

SEQ ID NO: 209893 - RNA, 1755 nt, Artificial Sequence; identical to SEQ ID NO: 209878
  derived and/or modified sequence opt5 from hemagglutinin__InfluenzaB__AGL09839

SEQ ID NO: 209894 - RNA, 1755 nt, Artificial Sequence; identical to SEQ ID NO: 209878
  derived and/or modified sequence opt5 from hemagglutinin__InfluenzaB__AGL09840

SEQ ID NO: 209895 - RNA, 1755 nt, Artificial Sequence; identical to SEQ ID NO: 209878
  derived and/or modified sequence opt5 from hemagglutinin__InfluenzaB__AGL09841

SEQ ID NO: 209896 - RNA, 1758 nt, Artificial Sequence
  derived and/or modified sequence opt5 from hemagglutinin__InfluenzaB__AGL09842
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgaaaccaacccucugacaauugaggugcccuacaucuguacggagggagaagaucagauuaccgucuggggcuuccacagcgacaaugagacacagauggcgaaacuuuauggggauucuaagccgcagaaguuuaccuccagcgccaacggaguuacaacccacuacgugucucaaaucggcggcuucccuaaccagacggaagacgggggacugccccaguccggcagaaucguggucgauuauauggugcaaaagagcgggaaaacaggaaccauuaccuaccagcggggcauccuccugccucagaagguuuggugcgcuucugggcgcuccaaagugauuaagggaagccuuccccugaucggcgaggccgacugucuccaugagaaauauggcgggcugaauaaguccaagcccuacuacacaggagaacacgcuaaagccauuggcaacugcccuaucugggucaagaccccgcugaaacucgcgaaugggacaaaguauagacccccugccaaacugcuuaaggagcggggauuuuucggcgcuaucgccggguuucuggaaggcggaugggagggcaugauugcuggguggcauggauacacgucucacggcgcccacgggguggccguugcugcggaucucaagagcacccaggaagccaucaacaaaauuacaaagaaucugaacucccuuagcgagcuggaggugaaaaaucuccagcgccugucuggagcuauggacgaacugcauaacgagauccucgaacuggaugagaaggucgacgaccuuagagccgauaccauuuccagccaaaucgaacuggccgugcuccugucuaaugagggcaucauuaacagcgaggacgaacaccuucuggcucucgagcggaaacugaagaagaugcuggggcccuccgccgucgaaaucggcaauggauguuucgagacaaaacauaagugcaaccagaccugccucgaucgcauugcggcuggcacguuugacgccggggaguucucucugccuaccuuugauagccuuaauaucacagccgcuucccugaacgacgauggacucgacaaucacaccauucugcuguauuacagcacagccgcuucuucccuugccgugacccucaugaucgcgauuuucguuguguauauggucagcagagauaacgugucuuguuccaucugccuguga

SEQ ID NO: 209897 - RNA, 1755 nt, Artificial Sequence; identical to SEQ ID NO: 209878
  derived and/or modified sequence opt5 from hemagglutinin__InfluenzaB__AGL09843

SEQ ID NO: 209898 - RNA, 1755 nt, Artificial Sequence
  derived and/or modified sequence opt5 from hemagglutinin__InfluenzaB__AGL09844
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaaagaggauggcgggcucccucagucuggaagaaucguggucgacuacaugaugcaaaagcccggcaaaaccgggacgauuguguaucagcggggaguucugcuuccucagaagguguggugcgcguccggccgcagcaaagucaucaaggggucccugccccucaucggagaagccgauugucugcaugagaaauacggcggccugaacaagucuaagcccuacuauacaggggaacacgcuaaagccauuggaaauugcccuaucugggugaagaccccgcucaaacuggcuaacggcaccaaguacagacccccugccaaacuucugaaggagcggggguuuuucggagccauugcuggcuuucucgaagggggcugggaaggaaugaucgcgggcuggcacggguauacaagccauggagcccacggcguugcuguggccgccgaccugaaguccacccaggaggcuauuaauaaaaucacaaagaaccuuaauagccugucugaacucgaggucaaaaaccugcaacgccuguccggggccauggacgaacuccauaaugagauccuggagcuugaugaaaagguggacgaucugagagcggacacgauuagcucucagaucgagcucgcuguccugcuuagcaacgaaggaauuaucaauuccgaggaugaacaucugcucgcccuggagcggaaacugaagaagaugcucggccccucugccguggacauugggaacggcuguuucgagaccaaacacaagugcaaucagacaugccuggaucgcaucgcugccggaaccuuuaacgcuggcgaguucagccuuccuacauuugacucccugaauaucaccgccgcgagccucaacgaugacgggcuggauaaucacacgauucugcuuuacuauucuaccgccgcuuccagccucgccguuacacugaugcuggcuaucuucauuguguacauggucucuagagacaacguguccuguagcaucugccucuga

SEQ ID NO: 209899 - RNA, 1755 nt, Artificial Sequence; identical to SEQ ID NO: 209878
  derived and/or modified sequence opt5 from hemagglutinin__InfluenzaB__AGL09845

SEQ ID NO: 209900 - RNA, 1755 nt, Artificial Sequence; identical to SEQ ID NO: 209878
  derived and/or modified sequence opt5 from hemagglutinin__InfluenzaB__AGL09846

SEQ ID NO: 209901 - RNA, 1755 nt, Artificial Sequence
  derived and/or modified sequence opt5 from hemagglutinin__InfluenzaB__AGL09847
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccauuuggggauuccauuccgacaauaaaacgcagaugaagaaccuguacggcgauagcaauccccaaaaguuuaccucuuccgcgaacggggucacaacccacuauguuagccagaucggaggcuucccggaccagacagaggauggcgggcucccucagucuggaagaauugugguggacuacaugaugcaaaaacccggcaagaccgggacgaucgucuaucagcggggagugcugcuuccucagaaaguuuggugcgccuccggccgcagcaaggugaucaaagggucccugccccucauuggagaagcugauugucugcaugagaaguacggcggccugaacaaaucuaagcccuacuauacaggggaacacgccaaggcuaucggaaauugcccuauuugggucaaaaccccgcucaagcuggccaacggcaccaaauacagacccccugccaaacuucugaaagagcggggguuuuucggagcuaucgcgggcuuucucgaagggggcugggaaggaaugauugccggcuggcacggguauacaagccauggagcucacggcguggccguugccgcugaccugaaguccacccaggaggccaucaauaagaucacaaagaaccuuaauagccugucugaacucgaggugaagaaccugcaacgccuguccggggcgauggacgaacuccauaaugagauucuggagcuugaugaaaaagucgacgaucugagagcugacacgaucagcucucagauugagcucgccgugcugcuuagcaacgaaggaaucauuaauuccgaggaugaacaucugcucgcccuggagcggaagcugaaaaagaugcucggccccucugcugucgacaucgggaacggcuguuucgagaccaagcacaaaugcaaucagacaugccuggaucgcaucgccgcuggaaccuuuaacgccggcgaguucagccuuccuacauuugacucccugaauauuaccgcggccagccucaacgaugacgggcuggauaaucacacgauccugcuuuacuauucuaccgcugccuccagccucgcugugacacugaugcuggccauuuucaucguuuacauggugucuagagacaacgucuccuguagcauuugccucuga

SEQ ID NO: 209902 - RNA, 1755 nt, Artificial Sequence
  derived and/or modified sequence opt5 from hemagglutinin__InfluenzaB__AGL09849
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucaacgccgaaaaagcuccuggcggcccguaccgccuggggaccagcggauccugccccaaugccacaagcaagucuggcuucuuugcgaccauggccugggcugucccuaaagauaacaauaagaacgccaccaauccccuuacaguggaggugccuuauauuugugcugaaggggaggaccagaucacggucuggggauuccauuccgauaacaaaacccagaugaagaaucuguacggcgacagcaacccccaaaaguuuacaucuuccgccaacgggguuaccacacacuaugugagccagauuggaggcuucccggaucagaccgaggacggcgggcucccucagucuggaagaaucguggucgauuacaugaugcaaaaacccggcaagacggggacaauuguguaucagcggggaguucugcuuccucagaaaguguggugcgcguccggccgcagcaaggucaucaaagggucccugccccucaucggagaagccgacugucugcaugagaaguacggcggccugaauaaaucuaagcccuacuauaccggggaacacgcuaaggccauuggaaacugcccuaucugggugaaaaccccgcucaagcuggcuaauggcacaaaauacagacccccugccaagcugcugaaagagcggggguuuuucggagccauugcuggcuuucucgaagggggcugggaaggaaugaucgcgggcuggcacggguauaccagccauggagcccacggcguugcuguggccgccgaucugaaguccacacaggaggcuauuaacaagaucacgaaaaaucuuaacagccugucugaacucgaggucaagaaucugcaacgccuguccggggccauggacgaacuccauaacgagauccuggagcuugacgaaaaaguggaugaccugagagcggauaccauuagcucucagaucgagcucgcuguccugcuuagcaaugaaggaauuaucaacuccgaggacgaacaccuucucgcccuggagcggaagcugaaaaagaugcucggccccucugccguggauauugggaauggcuguuucgagacaaagcacaaaugcaaccagaccugccuggaccgcaucgcugccggaacauuuaaugcuggcgaguucagccuuccuaccuuugauucccugaacaucacggccgcgagccucaaugacgaugggcuggacaaccauaccauucugcuuuacuauucuacagccgcuuccagccucgccguuacccugaugcuggcuaucuucauuguguacauggucucuagagauaacguguccuguagcaucugccucuga

SEQ ID NO: 209903 - RNA, 1755 nt, Artificial Sequence; identical to SEQ ID NO: 209878
  derived and/or modified sequence opt5 from hemagglutinin__InfluenzaB__AGL09850

SEQ ID NO: 209904 - RNA, 1755 nt, Artificial Sequence; identical to SEQ ID NO: 209878
  derived and/or modified sequence opt5 from hemagglutinin__InfluenzaB__AGL09851

SEQ ID NO: 209905 - RNA, 1758 nt, Artificial Sequence; identical to SEQ ID NO: 209669
  derived and/or modified sequence opt5 from hemagglutinin__InfluenzaB__AGL09852

SEQ ID NO: 209906 - RNA, 1755 nt, Artificial Sequence; identical to SEQ ID NO: 209878
  derived and/or modified sequence opt5 from hemagglutinin__InfluenzaB__AGL09853

SEQ ID NO: 209907 - RNA, 1755 nt, Artificial Sequence; identical to SEQ ID NO: 209878
  derived and/or modified sequence opt5 from hemagglutinin__InfluenzaB__AGL09854

SEQ ID NO: 209908 - RNA, 1758 nt, Artificial Sequence
  derived and/or modified sequence opt5 from hemagglutinin__InfluenzaB__AGL09855
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgaaaccaacccucugacaauugaggugcccuacaucuguacggaggaagaggaucagauuaccgucuggggauuccacagcgacaaugaaacacagauggcgaaacuuuauggcgauucuaagccgcagaaguuuaccuccagcgccaacgggguuacaacccacuacgugucucaaaucggagacuucccuaaccagacggaggauggcggccugccccaguccgggagaaucguggucgacuauauggugcaaaagagcggaaaaacaggcaccauuaccuaccagcgggggauccuccugccucagaagguuuggugcgcuucuggacgcuccaaagugauuaagggcagccuuccccugaucggggaggccgauugucuccaugaaaaauauggaggccugaauaaguccaagcccuacuacacaggcgagcacgcuaaagccauugggaacugcccuaucugggucaagaccccgcugaaacucgcgaauggaacaaaguauagacccccugccaaacugcuuaaggaacggggcuuuuucggggcuaucgccggauuucuggagggcgggugggaaggcaugauugcuggauggcauggcuacacgucucacggggcccacggaguggccguugcugcggaccucaagagcacccaggaggccaucaacaaaauuacaaagaaucugaacucccuuagcgagcuggaagugaaaaaucuccagcgccugucuggcgcuauggaugagcugcauaacgaaauccucgagcuggacgaaaaggucgacgaucuuagagccgacaccauuuccagccaaaucgagcuggccgugcuccugucuaaugaggggaucauuaacagcgaagaugagcaccuucuggcucucgaacggaaacugaagaagaugcugggacccuccgccgucgagaucggcaauggguguuucgaaacaaaacauaagugcaaccagaccugccucgaccgcauugcggcuggcacguuugaugccggagaguucucucugccuaccuuugacagccuuaauaucacagccgcuucccugaacgaugacggccucgauaaucacaccauucugcuguauuacagcacagccgcuucuucccuugccgugacccucaugaucgcgauuuucguuguguauauggucagcagagacaacgugucuuguuccaucugccuguga

SEQ ID NO: 209909 - RNA, 1755 nt, Artificial Sequence; identical to SEQ ID NO: 209878
  derived and/or modified sequence opt5 from hemagglutinin__InfluenzaB__AGL09856

SEQ ID NO: 209910 - RNA, 1755 nt, Artificial Sequence
  derived and/or modified sequence opt5 from hemagglutinin__InfluenzaB__AGL09857
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaagugaucgaugccgaaaaggcuccuggcggcccguaccgccuggggaccagcggauccugccccaaugccacaagcaaaucuggcuucuuugcgaccauggccugggcugucccuaaggacaacaauaaaaacgccaccaauccccuuacaguggaggugccuuauauuugugcugaaggggaggaucagaucacggucuggggauuccauuccgacaacaagacccagaugaagaaucuguacggcgauagcaacccccaaaaauuuacaucuuccgccaaugggguuaccacacacuaugugagccagauuggaggcuucccggaccagaccgaggauggcgggcucccucagucuggaagaaucguggucgacuacaugauucaaaagcccggcaaaacggggacaaucguguaucagcggggaguucugcuuccucagaagguguggugcgcguccggccgcagcaaagucaucaaggggucccugccccucauuggagaagccgauugucugcaugagaaauacggcggccugaacaagucuaagcccuacuauaccggggaacacgcuaaagccaucggaaacugcccuauuugggugaagaccccgcucaaacuggcuaauggcacaaaguacagacccccugccaaacuucugaaggagcggggguuuuucggagccaucgcuggcuuucucgaagggggcugggaaggaaugauugcgggcuggcacggguauaccagccauggagcccacggcguugcuguggccgccgaccugaaguccacacaggaggcuaucaacaaaaucacgaagaaucuuaacagccugucugaacucgaggucaaaaaucugcaacgccuguccggggccauggacgaacuccauaacgagauucuggagcuugaugaaaagguggacgaucugagagcggacaccaucagcucucagauugagcucgcuguccugcuuagcaaugaaggaaucauuaacuccgaggaugaacaucugcucgcccuggagcggaaacugaagaagaugcucggccccucugccguggacaucgggaauggcuguuucgagacaaaacacaagugcaaccagaccugccuggaucgcaucgcugccggaacauuuaaugcuggcgaguucagccuuccuaccuuugacucccugaacauuacggccgcgagccucaaugaugacgggcuggauaaccacaccauccugcuuuacuauucuacagccgcuuccagccucgccguuacccugaugcuggcuauuuucaucguguacauggucucuagagacaauguguccuguagcauuugccucuga

SEQ ID NO: 209911 - RNA, 1758 nt, Artificial Sequence
  derived and/or modified sequence opt5 from hemagglutinin__InfluenzaB__AGL09859
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcaaaagagcgggaaaacaggaaccauuaccuaccagcggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaccucaagagcacccaggaggcuaucaauaaaauuacaaagaaccuuaauucccuuagcgaacuggaggugaaaaaccuccagcgccugucuggagccauggaugagcugcauaaugaaauccucgagcuggacgaaaaggucgacgaucuuagagccgacaccauuuccagccaaaucgagcuggcugugcuccugucuaacgaaggcaucauuaauagcgaggaugagcaccuucuggcccucgaacggaaacugaagaagaugcuggggcccuccgcggucgagaucggcaacggauguuucgaaacaaaacauaagugcaaucagaccugccucgaccgcauugcugccggcacguuugaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagcagagacaaugugucuuguuccaucugccuguga

SEQ ID NO: 209912 - RNA, 1758 nt, Artificial Sequence; identical to SEQ ID NO: 209911
  derived and/or modified sequence opt5 from hemagglutinin__InfluenzaB__AGL09860

SEQ ID NO: 209913 - RNA, 1758 nt, Artificial Sequence; identical to SEQ ID NO: 209911
  derived and/or modified sequence opt5 from hemagglutinin__InfluenzaB__AGL09861

SEQ ID NO: 209914 - RNA, 1758 nt, Artificial Sequence; identical to SEQ ID NO: 209911
  derived and/or modified sequence opt5 from hemagglutinin__InfluenzaB__AGL09862

SEQ ID NO: 209915 - RNA, 1758 nt, Artificial Sequence; identical to SEQ ID NO: 209911
  derived and/or modified sequence opt5 from hemagglutinin__InfluenzaB__AGL09863

SEQ ID NO: 209916 - RNA, 1755 nt, Artificial Sequence; identical to SEQ ID NO: 209878
  derived and/or modified sequence opt5 from hemagglutinin__InfluenzaB__AGL09864

SEQ ID NO: 209917 - RNA, 1755 nt, Artificial Sequence; identical to SEQ ID NO: 209878
  derived and/or modified sequence opt5 from hemagglutinin__InfluenzaB__AGL09866

SEQ ID NO: 209918 - RNA, 1755 nt, Artificial Sequence; identical to SEQ ID NO: 209878
  derived and/or modified sequence opt5 from hemagglutinin__InfluenzaB__AGL09867

SEQ ID NO: 209919 - RNA, 1755 nt, Artificial Sequence; identical to SEQ ID NO: 209878
  derived and/or modified sequence opt5 from hemagglutinin__InfluenzaB__AGL09868

SEQ ID NO: 209920 - RNA, 1755 nt, Artificial Sequence
  derived and/or modified sequence opt5 from hemagglutinin__InfluenzaB__AGL09869
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacacaaccagcaagucuggcuucuuugccaccauggcgugggccgucccuaaagacaauaacaagaaugcuacaaacccccuuacgguggaggugccuuauauuugugccgaaggggaggaucagaucaccgucuggggauuccauuccgacaauaaaacacagaugaagaaccuguacggcgauagcaauccccaaaaguuuaccucuuccgcuaacgggguuacaacccacuaugugagccagauuggaggcuucccggaccagacggaggauggcgggcucccucagucuggaagaaucguggucgacuacaugaugcaaaaacccggcaagacagggaccauuguguaucagcggggaguucugcuuccucagaaaguguggugcgccuccggccgcagcaaggucaucaaagggucccugccccucaucggagaagcggauugucugcaugagaaguacggcggccugaacaaaucuaagcccuacuauaccggggaacacgccaaggcuauuggaaauugcccuaucugggugaaaacaccgcucaagcuggccaacggcaccaaauacagacccccugcuaagcugcugaaagagcggggguuuuucggagccauugccggcuuucucgaagggggcugggaaggaaugaucgcuggcuggcacggguauacaagccauggagcgcacggcguugccguggcugccgaccugaaguccacgcaggaggccauuaauaagaucaccaaaaaccuuaauagccugucugaacucgaggucaagaaccugcaacgccuguccggggcuauggacgaacuccauaaugagauccuggagcuugaugaaaaaguggacgaucugagagccgacacaauuagcucucagaucgagcucgcgguccugcuuagcaacgaaggaauuaucaauuccgaggaugaacaccuucucgcucuggagcggaagcugaaaaagaugcucggccccucugccguggacauugggaacggcuguuucgagaccaagcacaaaugcaaucagacaugccuggaucgcaucgccgcuggaaccuuuaacgccggcgaguucagccuuccuacguuugacucccugaauaucaccgcugccagccucaacgaugacgggcuggauaaucauacaauucugcuuuacuauucuaccgcggccuccagccucgcuguuacacugaugcuggccaucuucauuguguacauggucucuagagacaacguguccuguagcaucugccucuga

SEQ ID NO: 209921 - RNA, 1755 nt, Artificial Sequence
  derived and/or modified sequence opt5 from hemagglutinin__InfluenzaB__AGL09870
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaagauuuacaucuuccgccaacgggguuaccacacacuaugugagccagauuggaggcuucccggaccagaccgaggauggcgggcucccucagucuggacggaucguggucgacuacaugaugcaaaagcccggcaaaacggggacaauuguguaucagcgcggaguucugcuuccucagaagguguggugcgcguccggcagaagcaaagucaucaaggggucccugccccucaucggagaagccgauugucugcaugagaaauacggcggccugaacaagucuaaacccuacuauaccggggaacacgcuaaggccauuggaaauugcccuaucugggugaagaccccgcucaaacuggcuaacggcacaaaguaccggcccccugccaaacuucugaaggagcgcggguuuuucggagccauugcuggcuuucucgaagggggcugggaaggaaugaucgcgggcuggcacggguauaccagccauggagcccacggcguugcuguggccgccgaccugaaauccacacaggaggcuauuaauaagaucacgaagaaccuuaauagccugucugaacucgaggucaaaaaccugcaaagacuguccggggccauggacgaacuccauaaugagauccuggagcuugaugaaaagguggacgaucugcgggcggacaccauuagcucucagaucgagcucgcuguccugcuuagcaacgaaggaauuaucaauuccgaggaugaacaucugcucgcccuggagcgcaaacugaagaaaaugcucggccccucugccguggacauugggaacggcuguuucgagacaaagcacaagugcaaucagaccugccuggauagaaucgcugccggaacauuuaacgcuggcgaguucagccuuccuaccuuugacucccugaauaucacggccgcgagccucaacgaugacgggcuggauaaucacaccauucugcuuuacuauucuacagccgcuuccagccucgccguuacccugaugcuggcuaucuucauuguguacauggucucucgggacaacguguccuguagcaucugccucuga

SEQ ID NO: 209922 - RNA, 1755 nt, Artificial Sequence; identical to SEQ ID NO: 209878
  derived and/or modified sequence opt5 from hemagglutinin__InfluenzaB__AGL09871

SEQ ID NO: 209923 - RNA, 1755 nt, Artificial Sequence
  derived and/or modified sequence opt5 from hemagglutinin__InfluenzaB__AGL09872
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccgucuggggauuccauuccgacaauaaaacgcagaugaagaaccuguacggcgauagcaauccccaaaaguuuaccucuuccgcgaacgggguuacaacccacuaugugagccagauuggaggcuucccggaccagacagaggauggcgggcucccucagucuggaagaaucguggucgacuacaugaugcaaaaacccggcaagaccgggacgauuguguaucagcggggaguucugcuuccucagaaaguguggugcgccuccggccgcagcaaggucaucaaagggucccugccccucaucggagaagcugauugucugcaugagaaguacggcggccugaacaaaucuaagcccuacuauacaggggaacacgccaaggcuauuggaaauugcccuaucugggugaaaaccccgcucaagcuggccaacggcaccaaauacagacccccugccaaacuucugaaagagcggggguuuuucggagcuauugcgggcuuucucgaagggggcugggaaggaaugaucgccggcuggcacggguauacaagccauggagcucacggcguugccguggccgcugaccugaaguccacccaggaggccauuaauaagaucacaaagaaccuuaauagccugucugaacucgaggucaagaaccugcaacgccuguccggggcgauggacgaacuccauaaugagauccuggagcuugaugaaaaaguggacgaucugagagcugacacgauuagcucucagaucgagcucgccguccugcuuagcaacgaaggaauuaucaauuccgaggaugaacaucugcucgcccuggagcggaagcugaaaaagaugcucggccccucugcuguggacauugggaacggcuguuucgagaccaagcacaaaugcaaucagacaugccuggaucgcaucgccgcuggaaccuuuaacgccggcgaguucagccuuccuacauuugacucccugaauaucaccgcggccagccucaacgaugacgggcuggauaaucacacgauucugcuuuacuauucuaccgcugccuccagccucgcuguuacacugaugcuggccaucuucauuguguacauggucucuagagacaacguguccuguagcaucugccucuga

SEQ ID NO: 209924 - RNA, 1755 nt, Artificial Sequence; identical to SEQ ID NO: 209878
  derived and/or modified sequence opt5 from hemagglutinin__InfluenzaB__AGL09873

SEQ ID NO: 209925 - RNA, 1758 nt, Artificial Sequence; identical to SEQ ID NO: 209911
  derived and/or modified sequence opt5 from hemagglutinin__InfluenzaB__AGL09874

SEQ ID NO: 209926 - RNA, 1758 nt, Artificial Sequence; identical to SEQ ID NO: 209896
  derived and/or modified sequence opt5 from hemagglutinin__InfluenzaB__AGO02695

SEQ ID NO: 209927 - RNA, 1755 nt, Artificial Sequence; identical to SEQ ID NO: 209878
  derived and/or modified sequence opt5 from hemagglutinin__InfluenzaB__AGQ16249

SEQ ID NO: 209928 - RNA, 1758 nt, Artificial Sequence; identical to SEQ ID NO: 209911
  derived and/or modified sequence opt5 from hemagglutinin__InfluenzaB__AGQ16250

SEQ ID NO: 209929 - RNA, 1758 nt, Artificial Sequence; identical to SEQ ID NO: 209911
  derived and/or modified sequence opt5 from hemagglutinin__InfluenzaB__AGQ16251

SEQ ID NO: 209930 - RNA, 1755 nt, Artificial Sequence
  derived and/or modified sequence opt5 from hemagglutinin__InfluenzaB__AGQ16252
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccggcgaaguccuacuucgcuaaucuuaaaggcacccggacgcgcgggaagcugugucccgauugccucaacuguaccgaccuggauguggcccuuggaagaccuaugugcgucggcacaacccccucugccaaagcuagcauucugcaugaagugcggccuguuacauccggguguuuucccaucaugcacgaccgcaccaagaucagacaacucccuaaucugcugcggggauaugagaacauucgccucucuacgcagaaugugaucgaugccgaaaaggcuccgggcggccccuacagacuggggacaagcggauccugcccuaacgccaccagcaaaauuggcuucuuugcgacaauggccugggcuguccccaaggacaauuauaaaaacgccaccaauccucuuaccguggaggugcccuacaucuguaaggaaggggaggaucagauuacagucuggggauuccauucugacaacaaaacgcagaugaagaaucuguauggcgauuccaacccgcaaaaguuuaccagcucugcuaaugggguuacaacccacuacgugucccagaucggagacuucccugaucagacagaggacggcggccucccccagagcgggcggauuguggucgauuauaugaugcaaaaaccuggaaagaccggcacgaucguguaccagcgcgggguucugcuuccccagaaaguguggugcgccucuggaagauccaaggucaucaaaggcagccugccccucauuggggaagcggacugucugcaugaggaauacggaggccugaacaaguccaaaccuuauuacacaggcaagcacgccaaggcuaucgggaacugcccgauuugggugaaaacaccccucaagcuggccaauggaaccaaauaucggccucccgcuaagcugcugaaagagcgcggcuuuuucggggccaucgccggauuucucgagggcgggugggaaggcaugauugcuggauggcacggcuacacaucucauggggcgcacggaguugccguggcugccgaccuuaagagcacccaggaggccaucaacaagaucaccaaaaaucuuaacucccugagcgaacucgaggucaagaaucugcaaagacugucuggcgcuauggaugaacuccauaacgagauucuggagcuugacgaaaaaguggaugaccugcgggccgauacgaucuccagccagauugagcucgcgguccugcuuucuaaugaagggaucauuaacagcgaggacgaacaucugcucgcucuggagcgcaagcugaaaaagaugcucggaccuuccgccguggauaucggcaauggguguuucgagaccaagcacaaaugcaaccagacaugccuggacagaaucgccgcuggcaccuuuaaugccggagaguucucucuucccacauuugauagccugaacauuaccgcugccucccucaaugacgauggccuggacaaccacacgauccugcuuuauuacagcaccgcggccucuucccucgcuguuacacugaugcuggccauuuucaucguguauauggucagccgggacaaugugucuuguuccauuugccucuga

SEQ ID NO: 209931 - RNA, 1755 nt, Artificial Sequence; identical to SEQ ID NO: 209878
  derived and/or modified sequence opt5 from hemagglutinin__InfluenzaB__AGQ16253

SEQ ID NO: 209932 - RNA, 1755 nt, Artificial Sequence
  derived and/or modified sequence opt5 from hemagglutinin__InfluenzaB__AGQ16255
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggauuaccacacacuauguuagccagaucggaggcuucccggaccagaccgaggauggcgggcucccucagucuggaagaauugugguggacuacaugaugcaaaaacccggcaagacggggacaaucgucuaucagcggggagugcugcuuccucagaaaguuuggugcgcguccggccgcagcaaggugaucaaagggucccugccccucauuggagaagccgauugucugcaugagaaguacggcggccugaacaaaucuaagcccuacuauaccggggaacacgcuaaggccaucggaaauugcccuauuugggucaaaaccccgcucaagcuggcuaacggcacaaaauacagacccccugccaagcugcugaaagagcggggguuuuucggagccaucgcuggcuuucucgaagggggcugggaaggaaugauugcgggcuggcacggguauaccagccauggagcccacggcguggcuguugccgccgaccugaaguccacacaggaggcuaucaauaagaucacgaaaaaccuuaauagccugucugaacucgaggugaagaaccugcaacgccuguccggggccauggacgaacuccauaaugagauucuggagcuugaugaaaaagucgacgaucugagagcggacaccaucagcucucagauugagcucgcugugcugcuuagcaacgaaggaaucauuaauuccgaggaugaacaccuucucgcccuggagcggaagcugaaaaagaugcucggccccucugccgucgacaucgggaacggcuguuucgagacaaagcacaaaugcaaucagaccugccuggaucgcaucgcugccggaacauuuaacgcuggcgaguucagccuuccuaccuuugacucccugaauauuacggccgcgagccucaacgaugacgggcuggauaaucauaucauucugcuuuacuauucuaccgccgcuuccagccucgccgugacacugaugcuggcuaucuucauuguuuacauggugucuagagacaacgucuccuguagcaucugccucuga

SEQ ID NO: 209933 - RNA, 1755 nt, Artificial Sequence
  derived and/or modified sequence opt5 from hemagglutinin__InfluenzaB__AGQ16256
augaaggccaucauugugcugcucauggucguuaccagcaacgcugacagaaucugcacaggcauuacguccucuaauagcccccacguggugaaaaccgucacacagggggaggugaacguuaccggagugaucccucugacaaccacaccgaccaaguccuacuucgccaaucuuaaaggcacgaagacccgggggaaacugugucccgauugccucaacuguacagaccuggaugucgcgcuuggacgcccuaugugcgugggcaccacacccucugcuaaggccagcauucugcaugaaguuagaccugugaccuccggguguuuucccaucaugcacgaccggacgaagauccgccaacucgccaaucugcugagaggauaugagaacauucggcucucuacacagaaugucaucgaugcugaaaaagccccuggcggcccguaccgccuggggaccagcggauccugccccaacgcuacaagcaagucuggcuucuuugccaccauggcgugggccgugccuaaagacuccaauaagaacgcuaccaauccccuuacaguggaggucccuuauauuugugccgaaggggaggaucagaucacgguuuggggauuccauagcgacaacaaaacccagaugaagaaucuguacggcgauucuaacccccaaaaguuuacauccagcgcuaauggggugaccacacacuaugugucucagauuggaggcuucccggaccagaccgaggauggcgggcucccucaguccggaagaaucgucguggacuacaugaugcaaaaacccggcaagacggggacaauuguuuaucagcggggagugcugcuuccucagaaagucuggugcgccagcggccgcuccaaggugaucaaagggucucugccccucaucggagaagcggauugucugcaugagaaguacggcggccugaacaaaagcaagcccuacuauaccggggaacacgccaaggcuauuggaaacugcccuaucuggguuaaaaccccgcucaagcuggccaauggcacaaaauacagacccccugcuaagcugcugaaagagcggggguuuuucggagccauugccggcuuucucgaagggggcugggaaggaaugaucgcuggcuggcacggguauaccucccauggagcgcacggcguggccgucgcugccgaccuuaagagcacacaggaggccauuaacaagaucacgaaaaaucuuaacucucuguccgaacucgaggugaagaaucugcaacgccugagcggggcuauggacgaacuccauaacgagauccuggagcuugaugaaaaagucgacgaucugagagccgacaccauuucuagccagaucgagcucgcggugcugcuuuccaaugaaggaauuaucaacucugaggaugaacaucugcucgcucuggagcggaagcugaaaaagaugcucggccccagcgccguugacauugggaauggcuguuucgagacaaagcacaaaugcaaccagaccugccuggaucgcaucgccgcuggaacauuuaaugccggcgaguucucccuuccuaccuuugacagccugaacaucacggcugccucucucaaugaugacgggcuggauaaccacaccauucugcuuuacuauuccacagcggccagcucucucgcugugacccugaugcuggccaucuucauugucuacaugguguccagagacaauguuagcuguuccaucugccucuga

SEQ ID NO: 209934 - RNA, 1755 nt, Artificial Sequence; identical to SEQ ID NO: 209878
  derived and/or modified sequence opt5 from hemagglutinin__InfluenzaB__AGQ16257

SEQ ID NO: 209935 - RNA, 1755 nt, Artificial Sequence; identical to SEQ ID NO: 209878
  derived and/or modified sequence opt5 from hemagglutinin__InfluenzaB__AGQ16258

SEQ ID NO: 209936 - RNA, 1755 nt, Artificial Sequence; identical to SEQ ID NO: 209878
  derived and/or modified sequence opt5 from hemagglutinin__InfluenzaB__AGQ16259

SEQ ID NO: 209937 - RNA, 1755 nt, Artificial Sequence
  derived and/or modified sequence opt5 from hemagglutinin__InfluenzaB__AGQ16260
augaagaccaucauugugcugcucauggucguuacaagcaacgccgacagaaucugcacgggcauuaccuccucuaauagcccccacguggugaaaacagcuacccagggggaggucaacgugacaggaguuaucccucugaccacaaccccgacgaaguccuacuucgccaaucuuaaaggcaccaagacacgggggaaacugugucccgauugccucaacuguaccgaccuggauguggcgcuuggacgcccuaugugcgucggcacaacccccucugcuaaggccagcauucugcaugaagugagaccuguuacguccggguguuuucccaucaugcacgaccggacaaagauccgccaacucgccaaucugcugagaggauaugagaacauucggcucucuagccagaaugugaucgaugcugaaaaagccccuggcggcccguaccgccuggggaccuccggaagcugccccaacgcuacaucuaaguccggcuucuuugccaccauggcgugggccgucccuaaagacaauaacaagaaugcuaccaacccccuuacaguggaggugccuuauauuugugccgaaggggaggaucagaucacggucuggggauuccauagcgacaauaaaacccagaugaagaaccuguacggcgauucuaauccccaaaaguuuacauccagcgcuaacgggguuaccacacacuaugugucucagauuggaggcuucccggaccagaccgaggauggcgggcucccucaguccggaagaaucguggucgacuacaugaugcaaaaacccggcaagacggggacaauuguguaucagcggggaguucugcuuccucagaaaguguggugcgccagcggccgcuccaaggucaucaaagggucucugccccucaucggagaagcggauugucugcaugagaaguacggcggccugaacaaaagcaagcccuacuauaccggggaacacgccaaggcuauuggaaauugcccuaucugggugaaaaccccgcucaagcuggccaacggcacaaaauacagacccccugcuaagcugcugaaagagcggggguuuuucggagccauugccggcuuucucgaagggggcugggaaggaaugaucgcuggcuggcacggguauaccucccauggagcgcacggcguugccguggcugccgaccuuaagagcacacaggaggccauuaauaagaucacgaaaaaccuuaauucucuguccgaacucgaggucaagaaccugcaacgccugagcggggcuauggacgaacuccauaaugagauccuggagcuugaugaaaaaguggacgaucugagagccgacaccauuucuagccagaucgagcucgcgguccugcuuuccaacgaaggaauuaucaauucugaggaugaacaucugcucgcucuggagcggaagcugaaaaagaugcucggccccagcgccguggacauugggaacggcuguuucgagacaaagcacaaaugcaaucagaccugccuggaucgcaucgccgcuggaacauuuaacgccggcgaguucucccuuccuaccuuugacagccugaauaucacggcugccucucucaacgaugacgggcuggauaaucacaccauucugcuuuacuauuccacagcggccagcucucucgcuguuacccugaugcuggccaucuucauuguguacauggucuccagagacaacgugagcuguuccaucugccucuga

SEQ ID NO: 209938 - RNA, 1755 nt, Artificial Sequence; identical to SEQ ID NO: 209878
  derived and/or modified sequence opt5 from hemagglutinin__InfluenzaB__AGQ16261

SEQ ID NO: 209939 - RNA, 1755 nt, Artificial Sequence; identical to SEQ ID NO: 209878
  derived and/or modified sequence opt5 from hemagglutinin__InfluenzaB__AGQ16262

SEQ ID NO: 209940 - RNA, 1758 nt, Artificial Sequence; identical to SEQ ID NO: 209911
  derived and/or modified sequence opt5 from hemagglutinin__InfluenzaB__AGQ16263

SEQ ID NO: 209941 - RNA, 1758 nt, Artificial Sequence; identical to SEQ ID NO: 209911
  derived and/or modified sequence opt5 from hemagglutinin__InfluenzaB__AGQ16264

SEQ ID NO: 209942 - RNA, 1755 nt, Artificial Sequence; identical to SEQ ID NO: 209923
  derived and/or modified sequence opt5 from hemagglutinin__InfluenzaB__AGQ16265

SEQ ID NO: 209943 - RNA, 1755 nt, Artificial Sequence
  derived and/or modified sequence opt5 from hemagglutinin__InfluenzaB__AGQ16266
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccaggugggaggcuucccggaccagaccgaggauggcgggcucccucagucuggaagaauugucguggacuacaugaugcaaaaacccggcaagacggggacaaucguuuaucagcggggagugcugcuuccucagaaagucuggugcgcguccggccgcagcaaggugauuaaagggucccugccccucaucggagaagccgauugucugcaugagaaguacggcggccugaacaaaucuaagcccuacuauaccggggaacacgcuaaggccaucggaaauugcccuauuuggguuaaaaccccgcucaagcuggcuaacggcacaaaauacagacccccugccaagcugcugaaagagcggggguuuuucggagccaucgcuggcuuucucgaagggggcugggaaggaaugauugcgggcuggcacggguauaccagccauggagcccacggcguggcugucgccgccgaccugaaguccacacaggaggcuaucaauaagauuacgaaaaaccuuaauagccugucugaacucgaggugaagaaccugcaacgccuguccggggccauggacgaacuccauaaugagauccuggagcuugaugaaaaagucgacgaucugagagcggacaccaucagcucucagauugagcucgcugugcugcuuagcaacgaaggaaucauuaauuccgaggaugaacaccuucucgcccuggagcggaagcugaaaaagaugcucggccccucugccguugacaucgggaacggcuguuucgagacaaagcacaaaugcaaucagaccugccuggaucgcauugcugccggaacauuuaacgcuggcgaguucagccuuccuaccuuugacucccugaauaucacggccgcgagccucaacgaugacgggcuggauaaucauaccauccugcuuuacuauucuacagccgcuuccagccucgccgugacccugaugcuggcuauuuucaucgucuacauggugucuagagacaacguuuccuguagcauuugccucuga

SEQ ID NO: 209944 - RNA, 1755 nt, Artificial Sequence; identical to SEQ ID NO: 209923
  derived and/or modified sequence opt5 from hemagglutinin__InfluenzaB__AGQ16267

SEQ ID NO: 209945 - RNA, 1755 nt, Artificial Sequence; identical to SEQ ID NO: 209923
  derived and/or modified sequence opt5 from hemagglutinin__InfluenzaB__AGQ16268

SEQ ID NO: 209946 - RNA, 1758 nt, Artificial Sequence; identical to SEQ ID NO: 209896
  derived and/or modified sequence opt5 from hemagglutinin__InfluenzaB__AGQ16269

SEQ ID NO: 209947 - RNA, 1755 nt, Artificial Sequence; identical to SEQ ID NO: 209923
  derived and/or modified sequence opt5 from hemagglutinin__InfluenzaB__AGQ16270

SEQ ID NO: 209948 - RNA, 1755 nt, Artificial Sequence
  derived and/or modified sequence opt5 from hemagglutinin__InfluenzaB__AGQ16272
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuagagacaauaacaaaaaugccaccaacccccuuacaguggaggugccuuauauuugugaagagggggaggaucagaucacggucuggggauuccauuccgacaauaagacccagaugaaaaaccuguacggcgauagcaauccccaaaaguuuacaucuuccgcuaacgggguuaccacacacuaugugagccagauuggaggcuucccggaccagaccgaagauggcgggcucccucagucuggacggaucguggucgacuacaugaugcaaaagcccggcaaaacggggacaauuguguaucagcgcggaguucugcuuccucagaagguguggugcgccuccggcagaagcaaagucaucaaggggucccugccccucaucggagaggcggauugucugcaugaaaaauacggcggccugaacaagucuaaacccuacuauaccggggagcacgccaaggcuauuggaaauugcccuaucugggugaagaccccgcucaaacuggccaacggcacaaaguaccggcccccugcuaaacuucugaaggagcgcggguuuuucggagccauugccggcuuucucgaagggggcugggagggaaugaucgcuggcuggcacggguauaccagccauggagcgcacggcguugccguggcugccgaccugaaauccacacaggaagccauuaauaagaucacgaagaaccuuaauagccugucugagcucgaagucaaaaaccugcaaagacuguccggggcuauggacgagcuccauaaugagauccuggaacuugaugagaagguggacgaucugcgggccgacaccauuagcucucagaucgaacucgcgguccugcuuagcaacgagggaauuaucaauuccgaagaugagcaucugcucgcucuggagcgcaaacugaagaaaaugcucggccccucugccguggacauugggaacggcuguuucgaaacaaagcacaagugcaaucagaccugccuggauagaaucgccgcuggaacauuuaacgccggcgaguucagccuuccuaccuuugacucccugaauaucacggcugccagccucaacgaugacgggcuggauaaucacaccauucugcuuuacuauucuacagcggccuccagccucgcuguuacccugaugcuggccaucuucauuguguacauggucucucgggacaacguguccuguagcaucugccucuga

SEQ ID NO: 209949 - RNA, 1755 nt, Artificial Sequence; identical to SEQ ID NO: 209878
  derived and/or modified sequence opt5 from hemagglutinin__InfluenzaB__AGQ16273

SEQ ID NO: 209950 - RNA, 1755 nt, Artificial Sequence; identical to SEQ ID NO: 209878
  derived and/or modified sequence opt5 from hemagglutinin__InfluenzaB__AGQ16274

SEQ ID NO: 209951 - RNA, 1755 nt, Artificial Sequence; identical to SEQ ID NO: 209878
  derived and/or modified sequence opt5 from hemagglutinin__InfluenzaB__AGQ16275

SEQ ID NO: 209952 - RNA, 1755 nt, Artificial Sequence; identical to SEQ ID NO: 209878
  derived and/or modified sequence opt5 from hemagglutinin__InfluenzaB__AGQ16276

SEQ ID NO: 209953 - RNA, 1755 nt, Artificial Sequence; identical to SEQ ID NO: 209923
  derived and/or modified sequence opt5 from hemagglutinin__InfluenzaB__AGQ16277

SEQ ID NO: 209954 - RNA, 1755 nt, Artificial Sequence; identical to SEQ ID NO: 209923
  derived and/or modified sequence opt5 from hemagglutinin__InfluenzaB__AGQ16278

SEQ ID NO: 209955 - RNA, 1755 nt, Artificial Sequence; identical to SEQ ID NO: 209923
  derived and/or modified sequence opt5 from hemagglutinin__InfluenzaB__AGQ16279

SEQ ID NO: 209956 - RNA, 1755 nt, Artificial Sequence; identical to SEQ ID NO: 209923
  derived and/or modified sequence opt5 from hemagglutinin__InfluenzaB__AGQ16280

SEQ ID NO: 209957 - RNA, 1755 nt, Artificial Sequence
  derived and/or modified sequence opt5 from hemagglutinin__InfluenzaB__AGQ16281
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaucuuucccggaccagaccgaggauggcggccucccucaguccgggagaaucguggucgacuacaugaugcaaaaacccggaaagacgggcacaauuguguaucagcgcgggguucugcuuccucagaaaguguggugcgcgagcggacgguccaaggucaucaaaggcucucugccccucaucggggaagccgauugucugcaugagaaguacggaggccugaacaaaagcaagcccuacuauaccggcgaacacgcuaaggccauugggaauugcccuaucugggugaaaaccccgcucaagcuggcuaacggaacaaaauacagacccccugccaagcugcugaaagagcggggcuuuuucggggccauugcuggauuucucgagggcgggugggaaggcaugaucgcgggauggcacggcuauaccucccauggggcccacggaguugcuguggccgccgaccuuaagagcacacaggaggcuauuaauaagaucacgaaaaaccuuaauucucuguccgaacucgaggucaagaaccugcaacgccugagcggcgccauggacgaacuccauaaugagauccuggagcuugaugaaaaaguggacgaucugagagcggacaccauuucuagccagaucgagcucgcuguccugcuuuccaacgaagggauuaucaauucugaggaugaacaucugcucgcccuggagcggaagcugaaaaagaugcucggacccagcgccguggacauuggcaacggguguuucgagacaaagcacaaaugcaaucagaccugccuggaucgcaucgcugccggcacauuuaacgcuggagaguucucccuuccuaccuuugacagccugaauaucacggccgcgucucucaacgaugacggccuggauaaucacaccauucugcuuuacuauuccacagccgcuagcucucucgccguuacccugaugcuggcuaucuucauuguguacauggucuccagagacaacgugagcuguuccaucugccucuga

SEQ ID NO: 209958 - RNA, 1755 nt, Artificial Sequence
  derived and/or modified sequence opt5 from hemagglutinin__InfluenzaB__AGQ16282
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagggaauaacaagaaugccaccaacccccuuacaguggaggugccuuauauuugugcugaaggagaggaccagaucacggucuggggcuuccauuccgauaauaaaacccagaugaagaaccuguacggggacagcaauccccaaagauuuacaucuuccgccaacggaguuaccacacacuaugugagccagauuggcggcuucccggaucagaccgaggacgggggacucccucagucuggccggaucguggucgauuacaugaugcaaaagcccgggaaaacgggaacaauuguguaucagcgcggcguucugcuuccucagaagguguggugcgcguccgggagaagcaaagucaucaagggaucccugccccucaucggcgaagccgacugucugcaugagaaauacggcgggcugaacaagucuaaacccuacuauaccggagaacacgcuaaggccauuggcaauugcccuaucugggugaagaccccgcucaaacuggcuaacgggacaaaguaccggcccccugccaaacuucugaaggagcgcggauuuuucggcgccauugcuggguuucucgagggcggaugggaaggcaugaucgcgggguggcacggauauaccagccauggcgcccacgggguugcuguggccgccgaucugaaauccacacaggaggcuauuaauaagaucacgaagaaccuuaauagccugucugaacucgaggucaaaaaccugcaaagacuguccggagccauggacgaacuccauaaugagauccuggagcuugacgaaaagguggaugaccugcgggcggauaccauuagcucucagaucgagcucgcuguccugcuuagcaacgaaggcauuaucaauuccgaggacgaacaucugcucgcccuggagcgcaaacugaagaaaaugcucgggcccucugccguggauauuggcaacggauguuucgagacaaagcacaagugcaaucagaccugccuggacagaaucgcugccggcacauuuaacgcuggggaguucagccuuccuaccuuugauucccugaauaucacggccgcgagccucaacgacgauggacuggacaaucacaccauucugcuuuacuauucuacagccgcuuccagccucgccguuacccugaugcuggcuaucuucauuguguacauggucucucgggauaacguguccuguagcaucugccucuga

SEQ ID NO: 209959 - RNA, 1755 nt, Artificial Sequence
  derived and/or modified sequence opt5 from hemagglutinin__InfluenzaB__AGQ16283
augaaggccaucauugugcugcucauggucguuaccagcaacgcugacagaaucugcacaggcauuacguccucuaauagcccccacguggugaaaaccgccacacauggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcacgaagugagaccuguuaccuccggguguuuucccaucaugcaugaccggacgaagauccgccagcucgcuaaucugcugagaggauaugagaacauucggcucucuacacaaaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccgucuggggauuccacuccgacaauaaaacgcagaugaagaaccuguacggcgauagcaauccccagaaguuuaccucuuccgcgaacgggguuacaacccauuaugugagccaaauuggaggcuucccggaccagacagaggauggcgggcucccucagucuggaagaaucguggucgacuacaugaugcagaaacccggcaagaccgggacgauuguguaucaacggggaguucugcuuccucagaaaguguggugcgccuccggccgcagcaaggucaucaaagggucccugccccucaucggagaagcugauugucugcacgagaaguacggcggccugaacaaaucuaagcccuacuauacaggggaacacgccaaggcuauuggaaauugcccuaucugggugaaaaccccgcucaagcuggccaacggcaccaaauacagacccccugccaaacuucugaaagagcggggguuuuucggagcuauugcgggcuuucucgaagggggcugggaaggaaugaucgccggcuggcauggguauacaagccacggagcucauggcguugccguggccgcugaccugaaguccacccaggaggccauuaauaagaucacaaagaaccuuaauagccugucugaacucgaggucaagaaccugcagcgccuguccggggcgauggacgaacuccacaaugagauccuggagcuugaugaaaaaguggacgaucugagagcugacacgauuagcucucaaaucgagcucgccguccugcuuagcaacgaaggaauuaucaauuccgaggaugaacaucugcucgcccuggagcggaagcugaaaaagaugcucggccccucugcuguggacauugggaacggcuguuucgagaccaagcacaaaugcaaucagacaugccuggaucgcaucgccgcuggaaccuuuaacgccggcgaguucagccuuccuacauuugacucccugaauaucaccgcggccagccucaacgaugacgggcuggauaaucacacgauucugcuuuacuauucuaccgcugccuccagccucgcuguuacacugaugcuggccaucuucauuguguacauggucucuagagacaacguguccuguagcaucugccucuga

SEQ ID NO: 209960 - RNA, 1758 nt, Artificial Sequence
  derived and/or modified sequence opt5 from hemagglutinin__InfluenzaB__AGQ16284
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggcccggccugugacauccggguguuuucccaucaugcaugaucgcaccaaaauuagacaacucccuaaucugcugcggggauacgaacacaucaagcucucuacgcauaacguuauuaaugcugagaacgccccgggcggccccuauaaaaucgggacaagcggauccugcccuaaugugaccaacggcaauggguucuuugcuacaauggccugggcgguccccaagaacgacaaaaauaagaccgccaccaacccucugacaauugaagugcccuacaucuguacggagggagaggaucagauuaccguguggggcuuccacagcgacaaugaaacacagauggcuaaacuuuauggggauucuaaaccgcagaaguuuaccuccagcgccaacggagucacaacccacuacguuucucaaaucggcggcuucccuaaccagacggaggacgggggacugccccaguccggccgcaucgugguggauuauaugguccagaaaagcgggaagacaggaaccauuaccuaccaaagaggcauccuccugccucagaaaguguggugcgcuucugggcgguccaagguuauuaaaggaagccuuccccugaucggcgaagccgacugucuccaugagaaguauggcgggcugaauaaguccaaacccuacuacacaggagagcacgcgaaggccauuggcaacugcccuaucugggugaaaaccccgcugaagcucgcuaaugggacaaaauauagacccccugccaagcugcuuaaggaacgcggauuuuucggcgcuaucgccggguuucuggagggcggaugggaaggcaugauugccggguggcauggauacacgucucacggcgcucacggggucgcgguggccgcugaucucaaaagcacccaggaggccaucaacaagauuacaaagaaucugaacucccuuagcgaacuggagguuaagaaucuccagcggcugucuggagccauggacgagcugcauaacgaaauccucgagcuggaugaaaaaguggacgaccuucgcgcugauaccauuuccagccaaaucgagcuggccguccuccugucuaaugaaggcaucauuaacagcgaggacgagcaccuucuggcgcucgaaagaaagcugaagaaaaugcuggggcccuccgcuguggagaucggcaauggauguuucgaaacaaagcauaaaugcaaccagaccugccucgaucggauugccgccggcacguuugacgcuggggaguucucucugccuaccuuugauagccuuaauaucacagccgcuucccugaacgacgauggacucgacaaucacaccauucugcuguauuacagcacagccgcgucuucccuugccgucacccucaugaucgcuauuuucgugguuuauauggugagccgcgauaacgucucuuguuccaucugccuguga

SEQ ID NO: 209961 - RNA, 1755 nt, Artificial Sequence; identical to SEQ ID NO: 209923
  derived and/or modified sequence opt5 from hemagglutinin__InfluenzaB__AGQ16285

SEQ ID NO: 209962 - RNA, 1755 nt, Artificial Sequence; identical to SEQ ID NO: 209923
  derived and/or modified sequence opt5 from hemagglutinin__InfluenzaB__AGQ16286

SEQ ID NO: 209963 - RNA, 1755 nt, Artificial Sequence
  derived and/or modified sequence opt5 from hemagglutinin__InfluenzaB__AGQ16287
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugaagagggggaggaucagaucacggucuggggauuccauuccgacaauaaaacccagaugaagaaccuguacggcgauagcaauccccaaaaguuuacaucuuccgcuaacgggguuaccacacacuaugugagccagauuggaggcuucccggaccagaccgaagauggcgggcucccucagucuggaagaaucguggucgacuacaugaugcaaaaacccggcaagacggggacaauuguguaucagcggggaguucugcuuccucagaaaguguggugcgccuccggccgcagcaaggucaucaaagggucccugccccucaucggagaggcggauugucugcaugaaaaguacggcggccugaacaaaucuaagcccuacuauaccggggagcacgccaaggcuauuggaaauugcccuaucugggugaaaaccccgcucaagcuggccaacggcacaaaauacagacccccugcuaagcugcugaaagagcggggguuuuucggagccauugccggcuuucucgaagggggcugggagggaaugaucgcuggcuggcacggguauaccagccauggagcgcacggcguugccguggcugccgaccugaaguccacacaggaagccauuaauaagaucacgaaaaaccuuaauagccugucugagcucgaagucaagaaccugcaacgccuguccggggcuauggacgagcuccauaaugagauccuggaacuugaugagaaaguggacgaucugagagccgacaccauuagcucucagaucgaacucgcgguccugcuuagcaacgagggaauuaucaauuccgaagaugagcaccuucucgcucuggagcggaagcugaaaaagaugcucggccccucugccguggacauugggaacggcuguuucgaaacaaagcacaaaugcaaucagaccugccuggaucgcaucgccgcuggaacauuuaacgccggcgaguucagccuuccuaccuuugacucccugaauaucacggcugccagccucaacgaugacgggcuggauaaucauaccauucugcuuuacuauucuacagcggccuccagccucgcuguuacccugaugcuggccaucuucauuguguacauggucucuagagacaacguguccuguagcaucugccucuga

SEQ ID NO: 209964 - RNA, 1755 nt, Artificial Sequence; identical to SEQ ID NO: 209878
  derived and/or modified sequence opt5 from hemagglutinin__InfluenzaB__AGQ16289

SEQ ID NO: 209965 - RNA, 1755 nt, Artificial Sequence; identical to SEQ ID NO: 209878
  derived and/or modified sequence opt5 from hemagglutinin__InfluenzaB__AGQ16290

SEQ ID NO: 209966 - RNA, 1755 nt, Artificial Sequence
  derived and/or modified sequence opt5 from hemagglutinin__InfluenzaB__AGQ16291
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacacaaccagcaagucuggcuucuuugccaccauggcgugggccgucccuaaagacaauaacaagaaugcuacaaacccccuuacgguggaggugccuuauauuugugccgaaggggaggaucagaucgcugucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugaucgcgggcuggcacggguauaccagccauggagcccacggcguugcuguggccgccgaccugaaguccacacaggaggcuauuaauaagaucacgaaaaaccuuaauagccugucugaacucgaggucaagaaccugcaacgccuguccggggccauggacgaacuccauaaugagauccuggagcuugaugaaaaaguggacgaucugagagcggacaccauuagcucucagaucgagcucgcuguccugcuuagcaacgaaggaauuaucaauuccgaggaugaacaccuucucgcccuggagcggaagcugaaaaagaugcucggccccucugccguggacauugggaacggcuguuucgagacaaagcacaaaugcaaucagaccugccuggaucgcaucgcugccggaacauuuaacgcuggcgaguucagccuuccuaccuuugacucccugaauaucacggccgcgagccucaacgaugacgggcuggauaaucauaccauucugcuuuacuauucuacagccgcuuccagccucgccguuacccugaugcuggcuaucuucauuguguacauggucucuagagacaacguguccuguagcaucugccucuga

SEQ ID NO: 209967 - RNA, 1755 nt, Artificial Sequence
  derived and/or modified sequence opt5 from hemagglutinin__InfluenzaB__AGQ16292
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccgucuggggauuccauuccgacaauaaaacgcagaugaagaaccuguacggcgauagcaauccccaaaaguuuaccucuuccgcgaacgggguuacaacccacuaugugagccagauuggaggcuucccggaccagacagaggauggcgggcucccucagucuggaagaaucguggucgacuacaugaugcaaaaacccggcaagaccgggacgauuguguaucagcggggaguucugcuuccucagaaaguguggugcgccuccggccgcagcaaggucaucaaagggucccugccccucaucggagaagcugauugucugcaugagaaguacggcggccugaacaaaucuaagcccuacuauacaggggaacacgccaaggcuauuggaaauugcccuaucugggugaaaaccccgcucaagcuggccaacggcaccaaauacagacccccugccaaacuucugaaagagcggggguuuuucggagcuauugcgggcuuucucgaagggggcugggaaggaaugaucgccggcuggcacggguauacaagccauggagcucacggcguugccguggccgcugaccugaaguccacccaggaggccauuaauaagaucacaaagaaccuuaauagccugucugaacucgagaucaagaaccugcaacgccuguccggggcgauggacgaacuccauaaugagauucuggagcuugaugaaaaagucgacgaucugagagcugacacgaucagcucucagauugagcucgccgugcugcuuagcaacgaaggaaucauuaauuccgaggaugaacaucugcucgcccuggagcggaagcugaaaaagaugcucggccccucugcugucgacaucgggaacggcuguuucgagaccaagcacaaaugcaaucagacaugccuggaucgcaucgccgcuggaaccuuuaacgccggcgaguucagccuuccuacauuugacucccugaauauuaccgcggccagccucaacgaugacgggcuggauaaucacacgauccugcuuuacuauucuaccgcugccuccagccucgcugugacacugaugcuggccauuuucaucguuuacauggugucuagagacaacgucuccuguagcauuugccucuga

SEQ ID NO: 209968 - RNA, 1755 nt, Artificial Sequence; identical to SEQ ID NO: 209967
  derived and/or modified sequence opt5 from hemagglutinin__InfluenzaB__AGQ16293

SEQ ID NO: 209969 - RNA, 1755 nt, Artificial Sequence; identical to SEQ ID NO: 209967
  derived and/or modified sequence opt5 from hemagglutinin__InfluenzaB__AGQ16294

SEQ ID NO: 209970 - RNA, 1758 nt, Artificial Sequence
  derived and/or modified sequence opt5 from hemagglutinin__InfluenzaB__AGQ16295
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacggaaacccgggggaagcugugucccaaaugccucaacuguacagaucuggacguugcccuuggacgcccuaagugcaccggcaagauucccucugccagagugagcauccugcacgagguccggccugugacauccggguguuuucccaucaugcaugaucgcaccaaaauuagacaacucccuaaucugcugcggggauacgaacacauccgccucucuacgcauaacguuauuaaugcugagaacgccccgggcggccccuauaagaucgggacaagcggauccugcccuaaugugaccaacggcaauggguucuuugcuacaauggccugggcgguccccaaaaacgacaagaauaaaaccgaaaccaacccucugacaauugaggugcccuacaucuguacggaggaagaggaucagauuaccguguggggauuccacagcgacaaugaaacacagauggccaaacuuuauggcgauucuaagccgcagaaguuuaccuccagcgcuaacggggucacaacccacuacguuucucaaaucggaggcuucccuaaccagacggaggacggcgggcugccccaguccggaagaaucgugguggauuauaugguccaaaagagcggcaaaacagggaccauuaccuaccagcggggaauccuccugccucagaagguguggugcgccucuggccgcuccaaaguuauuaaggggagccuuccccugaucggagaggcugacugucuccaugaaaaauauggcggccugaauaaguccaagcccuacuacacaggggagcacgccaaagcgauuggaaacugcccuaucugggugaagaccccgcugaaacucgccaauggcacaaaguauagacccccugcuaaacugcuuaaggaacggggguuuuucggagccaucgcuggcuuucuggaagggggcugggagggaaugauugccggcuggcauggguacacgucucacggagcccacggcgucgcuguggcggccgaucucaagagcacccaggaggcuaucaacaaaauuacaaagaaucugaacucccuuagcgagcuggaaguuaaaaaucuccagcgccugucuggggccauggacgagcugcauaacgaaauccucgagcuggaugaaaagguggacgaccuuagagccgauaccauuuccagccaaaucgagcuggcuguccuccugucuaaugagggaaucauuaacagcgaagacgagcaccuucuggcccucgaacggaaacugaagaagaugcugggccccuccgcgguggagaucgggaauggcuguuucgaaacaaaacauaagugcaaccagaccugccucgaucgcauugcugccggaacguuugacgccggcgaguucucucugccuaccuuugauagccuuaauaucacagcugccucccugaacgacgaugggcucgacaaucacaccauucugcuguauuacagcacagcugccucuucccuugcggucacccucaugaucgccauuuucgugguuuauauggugagcagagauaacgucucuuguuccaucugccuguga

SEQ ID NO: 209971 - RNA, 1758 nt, Artificial Sequence; identical to SEQ ID NO: 209911
  derived and/or modified sequence opt5 from hemagglutinin__InfluenzaB__AGQ16296

SEQ ID NO: 209972 - RNA, 1755 nt, Artificial Sequence; identical to SEQ ID NO: 209878
  derived and/or modified sequence opt5 from hemagglutinin__InfluenzaB__AGQ16297

SEQ ID NO: 209973 - RNA, 1755 nt, Artificial Sequence
  derived and/or modified sequence opt5 from hemagglutinin__InfluenzaB__AGQ16298
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugaucgcgggcuggcacggguauaccagccauggagcccacggcguugcuauugccgccgaccugaaguccacacaggaggcuaucaauaagaucacgaaaaaccuuaauagccugucugaacucgaggugaagaaccugcaacgccuguccggggccauggacgaacuccauaaugagauucuggagcuugaugaaaaagucgacgaucugagagcggacaccaucagcucucagauugagcucgcugugcugcuuagcaacgaaggaaucauuaauuccgaggaugaacaccuucucgcccuggagcggaagcugaaaaagaugcucggccccucugccgucgacaucgggaacggcuguuucgagacaaagcacaaaugcaaucagaccugccuggaucgcaucgcugccggaacauuuaacgcuggcgaguucagccuuccuaccuuugacucccugaauauuacggccgcgagccucaacgaugacgggcuggauaaucauaccauccugcuuuacuauucuacagccgcuuccagccucgccgugacccugaugcuggcuauuuucaucguuuacauggugucuagagacaacgucuccuguagcauuugccucuga

SEQ ID NO: 209974 - RNA, 1755 nt, Artificial Sequence; identical to SEQ ID NO: 209923
  derived and/or modified sequence opt5 from hemagglutinin__InfluenzaB__AGQ16299

SEQ ID NO: 209975 - RNA, 1755 nt, Artificial Sequence; identical to SEQ ID NO: 209923
  derived and/or modified sequence opt5 from hemagglutinin__InfluenzaB__AGQ16300

SEQ ID NO: 209976 - RNA, 1755 nt, Artificial Sequence; identical to SEQ ID NO: 209878
  derived and/or modified sequence opt5 from hemagglutinin__InfluenzaB__AGQ16301

SEQ ID NO: 209977 - RNA, 1755 nt, Artificial Sequence; identical to SEQ ID NO: 209878
  derived and/or modified sequence opt5 from hemagglutinin__InfluenzaB__AGQ16302

SEQ ID NO: 209978 - RNA, 1755 nt, Artificial Sequence; identical to SEQ ID NO: 209878
  derived and/or modified sequence opt5 from hemagglutinin__InfluenzaB__AGQ16303

SEQ ID NO: 209979 - RNA, 1755 nt, Artificial Sequence; identical to SEQ ID NO: 209878
  derived and/or modified sequence opt5 from hemagglutinin__InfluenzaB__AGQ16305

SEQ ID NO: 209980 - RNA, 1758 nt, Artificial Sequence
  derived and/or modified sequence opt5 from hemagglutinin__InfluenzaB__AGQ16306
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgaaaccaacccucugacaauugaggugcccuacaucuguaaggagggagaagaucagauuacggucuggggcuuccacagcgacaaugagacccagauggcgaaacuuuauggggauucuaagccgcagaaguuuacauccagcgccaacggaguuaccacacacuacgugucucaaaucggcggcuucccuaaccagaccgaagacgggggacugccccaguccggcagaaucguggucgauuauauggugcagaaaagcgggaagacgggaacaauuaccuaccaacggggcauccuccugccucagaaaguuuggugcgcuucugggcgcuccaaggugauuaaaggaagccuuccccugaucggcgaggccgacugucuccaugagaaguauggcgggcugaauaaguccaaacccuacuacaccggagaacacgcuaaggccauuggcaacugcccuaucugggucaaaacaccgcugaagcucgcgaaugggaccaaauauagacccccugccaagcugcuuaaggagcggggauuuuucggcgcuaucgccggguuucuggaaggcggaugggagggcaugauugcuggguggcauggauacacaucucacggcgcccacgggguggccguugcugcggaucucaaaagcacgcaggaagccaucaacaagauuaccaaaaaucugaacucccuuagcgagcuggaggugaagaaucuccagcgccugucuggagcuauggacgaacugcauaacgagauccucgaacuggaugagaaagucgacgaccuuagagccgauacaauuuccagccaaaucgaacuggccgugcuccugucuaaugagggcaucauuaacagcgaggacgaacaccuucuggcucucgagcggaagcugaagaaaaugcuggggcccuccgccgucgaaaucggcaauggauguuucgagaccaagcauaaaugcaaccagacaugccucgaucgcauugcggcuggcaccuuugacgccggggaguucucucugccuacguuugauagccuuaauaucaccgccgcuucccugaacgacgauggacucgacaaucacacaauucugcuguauuacagcaccgccgcuucuucccuugccgugacacucaugaucgcgauuuucguuguguauauggucagcagagauaacgugucuuguuccaucugccuguga

SEQ ID NO: 209981 - RNA, 1755 nt, Artificial Sequence; identical to SEQ ID NO: 209878
  derived and/or modified sequence opt5 from hemagglutinin__InfluenzaB__AGQ16307

SEQ ID NO: 209982 - RNA, 1758 nt, Artificial Sequence; identical to SEQ ID NO: 209911
  derived and/or modified sequence opt5 from hemagglutinin__InfluenzaB__AGQ16308

SEQ ID NO: 209983 - RNA, 1755 nt, Artificial Sequence
  derived and/or modified sequence opt5 from hemagglutinin__InfluenzaB__AGQ16309
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggcggacuacaugaugcaaaaacccggcaagacggggacaauugucuaucagcggggagugcugcuuccucagaaaguuuggugcgccuccggccgcagcaaggugaucaaagggucccugccccucaucggagaagcugauugucugcaugagaaguacggcggccugaacaaaucuaagcccuacuauaccggggaacacgccaaggcuauuggaaauugcccuaucugggucaaaaccccgcucaagcuggccaacggcacaaaauacagacccccugccaagcugcugaaagagcggggguuuuucggagcuauugcgggcuuucucgaagggggcugggaaggaaugaucgccggcuggcacggguauaccagccauggagcucacggcguggccguugccgcugaccugaaguccacacaggaggccauuaauaagaucacgaaaaaccuuaauagccugucugaacucgaggugaagaaccugcaacgccuguccggggcgauggacgaacuccauaaugagauccuggagcuugaugaaaaagucgacgaucugagagcugacaccauuagcucucagaucgagcucgccgugcugcuuagcaacgaaggaauuaucaauuccgaggaugaacaccuucucgcccuggagcggaagcugaaaaagaugcucggccccucugcugucgacauugggaacggcuguuucgagacaaagcacaaaugcaaucagaccugccuggaucgcaucgccgcuggaacauuuaacgccggcgaguucagccuuccuaccuuugacucccugaauaucacggcggccagccucaacgaugacgggcuggauaaucauaccauucugcuuuacuauucuacagcugccuccagccucgcugugacccugaugcuggccaucuucauuguuuacauggugucuagagacaacgucuccuguagcaucugccucuga

SEQ ID NO: 209984 - RNA, 1755 nt, Artificial Sequence
  derived and/or modified sequence opt5 from hemagglutinin__InfluenzaB__AGQ16310
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugguugcgggcuggcacggguauaccagccauggagcccacggcguggcugucgccgccgaccugaaguccacacaggaggcuaucaauaagauuacgaaaaaccuuaauagccugucugaacucgaggugaagaaccugcaacgccuguccggggccauggacgaacuccauaaugagauccuggagcuugaugaaaaagucgacgaucugagagcggacaccaucagcucucagauugagcucgcugugcugcuuagcaacgaaggaaucauuaauuccgaggaugaacaccuucucgcccuggagcggaagcugaaaaagaugcucggccccucugccguugacaucgggaacggcuguuucgagacaaagcacaaaugcaaucagaccugccuggaucgcauugcugccggaacauuuaacgcuggcgaguucagccuuccuaccuuugacucccugaauaucacggccgcgagccucaacgaugacgggcuggauaaucauaccauccugcuuuacuauucuacagccgcuuccagccucgccgugacccugaugcuggcuauuuucaucgucuacauggugucuagagacaacguuuccuguagcauuugccucuga

SEQ ID NO: 209985 - RNA, 1758 nt, Artificial Sequence; identical to SEQ ID NO: 209911
  derived and/or modified sequence opt5 from hemagglutinin__InfluenzaB__AGQ16311

SEQ ID NO: 209986 - RNA, 1755 nt, Artificial Sequence; identical to SEQ ID NO: 209878
  derived and/or modified sequence opt5 from hemagglutinin__InfluenzaB__AGQ16312

SEQ ID NO: 209987 - RNA, 1755 nt, Artificial Sequence
  derived and/or modified sequence opt5 from hemagglutinin__InfluenzaB__AGQ16313
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucgccgucuggggauuccauuccgacaauaaaacgcagaugaagaaccuguacggcgauagcaauccccaaaaguuuaccucuuccgcgaacgggguuacaacccacuaugugagccagauuggaggcuucccggaccagacagaggauggcgggcucccucagucuggaagaaucguggucgacuacaugaugcaaaaacccggcaagaccgggacgauuguguaucagcggggaguucugcuuccucagaaaguguggugcgccuccggccgcagcaaggucaucaaagggucccugccccucaucggagaagcugauugucugcaugagaaguacggcggccugaacaaaucuaagcccuacuauacaggggaacacgccaaggcuauuggaaauugcccuaucugggugaaaaccccgcucaagcuggccaacggcaccaaauacagacccccugccaagcugcugaaagagaagggguuuuucggagcuauugcgggcuuucucgaagggggcugggaaggaaugaucgccggcuggcacggguauacaagccauggagcucacggcguugccguggccgcugaccugaaguccacccaggaggccauuaauaaaaucacaaagaaccuuaauagccugucugaacucgaggucaaaaaccugcaacggcuguccggggcgauggacgaacuccauaaugagauccuggagcuugaugaaaagguggacgaucugcgcgcugacacgauuagcucucagaucgagcucgccguccugcuuagcaacgaaggaauuaucaauuccgaggaugaacaccuucucgcccuggagagaaaacugaagaagaugcucggccccucugcuguggacauugggaacggcuguuucgagaccaaacacaagugcaaucagacaugccuggaucggaucgccgcuggaaccuuuaacgccggcgaguucagccuuccuacauuugacucccugaauaucaccgcggccagccucaacgaugacgggcuggauaaucauacgauucugcuuuacuauucuaccgcugccuccagccucgcuguuacacugaugcuggccaucuucauuguguacauggucucucgcgacaacguguccuguagcaucugccucuga

SEQ ID NO: 209988 - RNA, 1758 nt, Artificial Sequence
  derived and/or modified sequence opt5 from hemagglutinin__InfluenzaB__AGQ16314
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgaaaccaacccucugacaauugaggugcccuacaucuguacggaggaagaggaucagauuaccgucuggggauuccacagcgacaaugaaacacagauggcgaaacuuuauggcgauucuaagccgcagaaguuuaccuccagcgccaacgggguuacaacccacuacgugucucaaaucggaggcuucccuaaccagacggaggacggcgggcugccccaguccggaagaaucguggucgauuauauggugcaaaagagcggcaaaacagggaccauuaccuaccagcggggaauccuccugccucagaagguuuggugcgcuucuggccgcuccaaagugauuaaggggagccuuccccugaucggagaggccgacugucuccaugaaaaauauggcggccugaauaaguccaagcccuacuacacaggggagcacgcuaaagccauuggaaacugcccuaucugggucaagaccccgcugaaacucgcgaauggcacaaaguauagacccccugccaaacugcuuaaggaacggggguuuuucggagcuaucgccggcuuucuggaagggggcugggagggaaugauugcuggcuggcauggguacacgucucacggagcccacggcguggccguugcugcggaucucaagagcacccaggaggccaucaacaaaauuacaaagaaucugaacucccuuagcgagcuggaagugaaaaaucuccagcgccugucuggggcuauggacgagcugcauaacgaaauccucgagcuggaugaaaaggucgacgaccuuagagccgauaccauuuccagccaaaucgagcuggccgugcuccugucuaaugagggaaucauuaacagcgaagacgagcaccuucuggcucucgaacggaaacugaagaagaugcugggccccuccgccgucgagaucgggaauggcuguuucgaaacaaaacauaagugcaaccagaccugccucgaucgcauugcggcuggaacguuugacgccggcgaguucucucugccuaccuuugauagccuuaauaucacagccgcuucccugaacgacgaugggcucgacaaucacaccauucugcuguauuacagcacagccgcuucuucccuugccgugacccucaugaucgcgauuuucguuguguauauggucagcagagauaacgugucuuguuccaucugccuguga

SEQ ID NO: 209989 - RNA, 1755 nt, Artificial Sequence
  derived and/or modified sequence opt5 from hemagglutinin__InfluenzaB__AGQ16315
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaccgugaucgaugccgaaaaagcuccuggcggcccguaccgccuggggacaagcggauccugccccaaugccaccagcaagucuggcuucuuugcgaccauggccugggcugucccuaaagacaacaauaagaacgccacaaauccccuuacgguggaggugccuuauauuugugcugaaggggaggaucagaucaccgucuggggauuccauuccgacaacaaaacacagaugaagaaucuguacggcgauagcaacccccaaaaguuuaccucuuccgccaaugggauuacaacccacuauguuagccagaucggaggcuucccggaccagacggaggauggcgggcucccucagucuggaagaauugugguggacuacaugaugcaaaaacccggcaagacagggaccaucgucuaucagcggggagugcugcuuccucagaaaguuuggugcgcguccggccgcagcaaggugaucaaagggucccugccccucauuggagaagccgauugucugcaugagaaguacggcggccugaacaaaucuaagcccuacuauaccggggaacacgcuaaggccaucggaaacugcccuauuugggucaaaacaccgcucaagcuggcuaauggcaccaaauacagacccccugccaagcugcugaaagagcggggguuuuucggagccaucgcuggcuuucucgaagggggcugggaaggaaugauugcgggcuggcacggguauacaagccauggagcccacggcguggcuguugccgccgaccugaaguccacgcaggaggcuaucaacaagaucaccaaaaaucuuaacagccugucugaacucgaggugaagaaucugcaacgccuguccggggccauggacgaacuccauaacgagauucuggagcuugaugaaaaagucgacgaucugagagcggacacaaucagcucucagauugagcucgcugugcugcuuagcaaugaaggaaucauuaacuccgaggaugaacaccuucucgcccuggagcggaagcugaaaaagaugcucggccccucugccgucgacaucgggaauggcuguuucgagaccaagcacaaaugcaaccagacaugccuggaucgcaucgcugccggaaccuuuaaugcuggcgaguucagccuuccuacguuugacucccugaacauuaccgccgcgagccucaaugaugacgggcuggauaaccauaucauucugcuuuacuauucuacagccgcuuccagccucgccgugacccugaugcuggcuaucuucauuguuuacauggugucuagagacaaugucuccuguagcaucugccucuga

SEQ ID NO: 209990 - RNA, 1755 nt, Artificial Sequence; identical to SEQ ID NO: 209878
  derived and/or modified sequence opt5 from hemagglutinin__InfluenzaB__AGQ16316

SEQ ID NO: 209991 - RNA, 1755 nt, Artificial Sequence; identical to SEQ ID NO: 209878
  derived and/or modified sequence opt5 from hemagglutinin__InfluenzaB__AGQ16317

SEQ ID NO: 209992 - RNA, 1758 nt, Artificial Sequence; identical to SEQ ID NO: 209669
  derived and/or modified sequence opt5 from hemagglutinin__InfluenzaB__AGQ16318

SEQ ID NO: 209993 - RNA, 1755 nt, Artificial Sequence
  derived and/or modified sequence opt5 from hemagglutinin__InfluenzaB__AGQ16319
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgaagacccgggggaaacugugucccggaugccucaacuguacagaucuggacguggcucuuggccgcccuaugugcgucgggaccacacccucugccaaggccagcauucugcaugaagugagaccuguuaccuccggauguuuucccaucaugcacgaucggacgaagauccgccaacucgcuaaucugcugagaggcuaugagaacauucggcucucuacacagaaugugaucgacgccgaaaaagcuccuggcgggccguaccgccugggaaccagcggcuccugccccaacgccacaagcaagucuggguucuuugcgaccauggccugggcugucccuaaagauaauaacaagaaugccaccaacccccuuacaguggaggugccuuauauuugugcugaaggagaggaccagaucgccgucuggggcuuccauuccgauaauaaaacgcagaugaagaaccuguacggggacagcaauccccaaaaguuuaccucuuccgcgaacggaguuacaacccacuaugugagccagauuggcggcuucccggaucagacagaggacgggggacucccucagucuggcagaaucguggucgauuacaugaugcaaaaacccgggaagaccggaacgauuguguaucagcggggcguucugcuuccucagaaaguguggugcgccuccgggcgcagcaaggucaucaaaggaucccugccccucaucggcgaagcugacugucugcaugagaaguacggcgggcugaacaaaucuaagcccuacuauacaggagaacacgccaaggcuauuggcaauugcccuaucugggugaaaaccccgcucaagcuggccaacgggaccaaauacagacccccugccaaacuucugaaagagcggggauuuuucggcgcuauugcgggguuucucgagggcggaugggaaggcaugaucgccggguggcacggauauacaagccauggcgcucacgggguugccguggccgcugaucugaaguccacccaggaggccauuaauaagaucacaaagaaccuuaauagccugucugaacucgaggucaagaaccugcaacgccuguccggagcgauggacgaacuccauaaugagauccuggagcuugacgaaaaaguggaugaccugagagcugauacgauuagcucucagaucgagcucgccguccugcuuagcaacgaaggcauuaucaauuccgaggacgaacaucugcucgcccuggagcggaagcugaaaaagaugcucgggcccucugcuguggauauuggcaacggauguuucgagaccaagcacaaaugcaaucagacaugccuggaccgcaucgccgcuggcaccuuuaacgccggggaguucagccuuccuacauuugauucccugaauaucaccgcggccagccucaacgacgauggacuggacaaucacacgauucugcuuuacuauucuaccgcugccuccagccucgcuguuacacugaugcuggccaucuucauuguguacauggucucuagagauaacguguccuguagcaucugccucuga

SEQ ID NO: 209994 - RNA, 1755 nt, Artificial Sequence; identical to SEQ ID NO: 209923
  derived and/or modified sequence opt5 from hemagglutinin__InfluenzaB__AGQ16320

SEQ ID NO: 209995 - RNA, 1755 nt, Artificial Sequence; identical to SEQ ID NO: 209878
  derived and/or modified sequence opt5 from hemagglutinin__InfluenzaB__AGQ16321

SEQ ID NO: 209996 - RNA, 1755 nt, Artificial Sequence; identical to SEQ ID NO: 209878
  derived and/or modified sequence opt5 from hemagglutinin__InfluenzaB__AGQ16322

SEQ ID NO: 209997 - RNA, 1758 nt, Artificial Sequence
  derived and/or modified sequence opt5 from hemagglutinin__InfluenzaB__AGQ16323
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgucucuuaaaggcacggaaacccgggggaagcugugucccaaaugccucaauuguacagaucuggacguggcucuuggacgcccuaagugcaccggcaagauucccagcgccagagucuccauccugcacgaggugcggccuguuacaucuggguguuuucccaucaugcaugaucgcaccaaaauuagacaacucccuaaccugcugcggggauacgaacacauccgccucagcacgcauaaugugauuaacgccgaggacgcuccgggcggccccuauaagaucgggacauccggaagcugcccuaaugucaccaacggcaauggguucuuugccacaauggcuugggccgugcccaaaaacgauaagaauaaaaccgcgaccaacccucugacaauugaagugcccuacaucuguacggagggagaggaccagauuaccgucuggggcuuccacucugauaaugaaacacagauggccaaacuuuauggggacuccaagccgcagaaguuuaccagcucugcuaacggaguuacaacccacuacgugucccaaaucggcggcuucccuaaucagacggaggaugggggacugccccagagcggcagaaucguggucgacuauauggugcagaagucugggaaaacaggaaccauuaccuaccaacggggcauccuccugccucagaagguuuggugcgccuccgggcgcagcaaagugauuaagggaucccuuccccugaucggcgaagcugauugucuccaugagaaauauggcgggcugaacaagucuaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgagccacggcgcccacgggguggcuguugcggccgaccucaaguccacccaggaggcuaucaacaaaauuacaaagaaucugaacagccuuucugaacuggaggugaaaaaucuccagcgccuguccggagccauggaugagcugcauaacgaaauccucgagcuggacgaaaaggucgacgaucuuagagccgacaccauuagcucucaaaucgagcuggcugugcuccugagcaaugaaggcaucauuaacuccgaggaugagcaccuucuggcccucgaacggaaacugaagaagaugcuggggcccucugcggucgagaucggcaauggauguuucgaaacaaaacauaagugcaaccagaccugccucgaccgcauugcugccggcacguuugaugccggggaguucagccugccuaccuuugacucccuuaauaucacagcugccagccugaacgaugacggacucgauaaucacaccauucugcuguauuacucuacagcugccuccagccuugcggugacccucaugaucgccauuuucguuguguauauggucucuagagacaacguguccuguagcaucugccuguga

SEQ ID NO: 209998 - RNA, 1755 nt, Artificial Sequence; identical to SEQ ID NO: 209878
  derived and/or modified sequence opt5 from hemagglutinin__InfluenzaB__AGQ16324

SEQ ID NO: 209999 - RNA, 1755 nt, Artificial Sequence; identical to SEQ ID NO: 209878
  derived and/or modified sequence opt5 from hemagglutinin__InfluenzaB__AGQ16325

SEQ ID NO: 210000 - RNA, 1755 nt, Artificial Sequence; identical to SEQ ID NO: 209878
  derived and/or modified sequence opt5 from hemagglutinin__InfluenzaB__AGQ16326

SEQ ID NO: 210001 - RNA, 1755 nt, Artificial Sequence; identical to SEQ ID NO: 209878
  derived and/or modified sequence opt5 from hemagglutinin__InfluenzaB__AGQ16327

SEQ ID NO: 210002 - RNA, 1758 nt, Artificial Sequence
  derived and/or modified sequence opt5 from hemagglutinin__InfluenzaB__AGQ16328
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagacacccucugccagagucagcauucugcacgaggugcggccuguuaccuccggguguuuucccaucaugcaugaucgcacgaaaaucagacaacucccuaaucugcugcggggauacgaacacauucgccucucuacacauaacgugaucaaugccgagaacgcuccgggcggccccuauaagauugggaccagcggauccugcccuaaugucacaaacggcaauggguucuuugccaccauggcuugggccgugcccaaaaacgacaagaauaaaaccgcgacaaacccucugacgaucgaagugcccuacauuuguaccgagggagaggaucagaucacagucuggggcuuccacagcgacaaugaaacccagauggccaagcuguauggggauucuaacccgcagaaguuuacauccagcgcuaacggaguuaccacgcacuacgugucucaaauuggcggcuucccuaaucagacagaggacgggggacugccccaguccggcagaaucguggucgauuauauggugcagaaaagcgggaagaccggaaccaucacauaccaacggggcauucuccugccucagaaaguuuggugcgccucugggcgcuccaaggugaucaaaggaagccuuccccugauuggcgaagcugacugucuccaugagaaguauggcgggcugaacaaauccaagcccuacuacaccggagagcacgccaaggcgaucggcaauugcccuauuugggucaaaacaccgcugaagcucgccaacgggacgaaauauagacccccugcuaagcugcuuaaagaacggggauuuuucggcgccaucgcuggguuucuggagggcggaugggaaggcaugaucgccggguggcauggauacaccucucacggcgcccacgggguggcuguugcggccgaucucaagagcacacaggaggcuauuaauaagaucaccaaaaaccuuaauucccuuagcgaacuggaggugaagaaccuccagcgccugucuggagccauggacgagcugcauaaugaaauucucgagcuggaugaaaaagucgacgaccuuagagccgauacaaucuccagccaaauugagcuggcugugcuccugucuaacgaaggcaucaucaauagcgaggacgagcaccuucuggcccucgaacggaagcugaaaaagaugcuggggcccuccgcggucgagauuggcaacggauguuucgaaaccaagcauaaaugcaaucagacgugccucgaucgcaucgcugccggcaccuuugacgccggggaguucucucugccuacauuugauagccuuaacauuaccgcugccucccugaaugacgauggacucgacaaccacacaauccugcuguauuacagcaccgcugccucuucccuugcggugacgcucaugauugccaucuucguuguguauauggucagcagagauaacgugucuuguuccauuugccuguga

SEQ ID NO: 210003 - RNA, 1758 nt, Artificial Sequence
  derived and/or modified sequence opt5 from hemagglutinin__InfluenzaB__AGX15487
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcgccuccgggcggagcaaggugauuaaaggaucccuuccucugaucggcgaggcugacugucuccaugaaaaguauggcgggcugaacaagucuaaacccuacuacacaggagagcacgccaaggcgauuggcaauugccccaucugggucaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacgggguggcuguugcggccgaucucaaauccacccaggaagcuaucaauaagauuacaaagaaccugaauagccuuucugagcuggaagugaagaaccuccagcggcuguccggagccauggacgagcugcauaaugagauccucgaacuggaugagaaagucgacgaccuucgcgccgauaccauuagcucucaaaucgaacuggcugugcuccugagcaacgagggcaucauuaauuccgaagacgagcaccuucuggcccucgagagaaagcugaagaaaaugcuggggccuucugcggucgaaaucggcaacggauguuucgagacaaagcauaaaugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgcgauaacguguccuguagcaucugccuguga

SEQ ID NO: 210004 - RNA, 1758 nt, Artificial Sequence; identical to SEQ ID NO: 210003
  derived and/or modified sequence opt5 from hemagglutinin__InfluenzaB__AGX15496

SEQ ID NO: 210005 - RNA, 1758 nt, Artificial Sequence
  derived and/or modified sequence opt5 from hemagglutinin__InfluenzaB__AGX15518
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccgcgccgacaaagucccauuucgcuaaucuuaaaggcaccaagacgcgggggaaacugugucccaagugccucaacuguaccgaucuggacguggcccuuggacgcccuaagugcacaggcaauauucccucugccgaagucagcauccugcacgaggugagaccuguuaccuccggguguuuucccaucaugcaugaucggacaaaaauucgccaacucccuaaccugcugagaggauacgaacacauccggcucucuacccauaaugugauuaacgcugagaaggccccgggcggccccuauaaaaucgggacgagcggauccugcccuaaugucacaaacggcaauggguucuuugcuaccauggccugggcggugcccaagaacgacaauaacaaaacagccaccaauagccugaccauugaagugccuuacaucuguacagagggagaggaucagauuacgaucuggggcuuccacucugacaacgaaacccagauggcuaagcuguauggggauuccaagccccagaaauuuacaagcucugccaacggagucaccacacacuacguuucccaaaucggcggcuucccgaaucagaccgaggacgggggacugccucagagcggccgcauugugguggauuauaugguccagaagcccgggaaaacgggaacaaucaccuaccaaagaggcauucuccugccucagaagguguggugcgcuucugggcgguccaaaguuaucaagggaagccuuccccugauuggcgaagccgacugucuccaugagaaauauggcgggcugaacaaguccaagcccuacuacaccggagagcacgcgaaagccaucggcaauugcccuaucugggugaagacaccgcugaaacucgcuaacgggaccaaguauagacccccugccaaacugcuuaaggaacgcggauuuuucggcgcuauugccggguuucuggagggcggaugggaaggcaugaucgccggguggcauggauacacaucucacggcgcucacggggucgcgguggccgcugaucucaagagcacgcaggaggccauuaauaaaaucaccaagaaccuuaauucccuuagcgaacuggagguuaaaaaccuccagcggcugucuuccgccauggacgagcugcauaaugaaauucucgagcuggaugaaaagguggacgaccuucgcgcugauacaaucagcucucaaaucgagcuggccguccuccugagcaacgaaggaauuaucaauuccgaggacgagcaccuucuggcgcucgaaagaaaacugaagaagaugcugggccccucugcuguggagauugggaacggcuguuucgaaaccaaacauaagugcaaucagacaugccucgaucggaucgccgccggaaccuuugacgcuggcgaguucagccugccuacguuugauucccuuaacauuaccgccgcuagccugaaugacgaugggcucgacaaccacacaauccugcuguauuacucuaccgccgcguccagccuugccgucacacucaugauugcuaucuucgugguuuauauggugucucgcgauaacgucuccuguagcaucugccuguga

SEQ ID NO: 210006 - RNA, 1758 nt, Artificial Sequence
  derived and/or modified sequence opt5 from hemagglutinin__InfluenzaB__AGX15529
augaaggccaucauugugcugcucauggucguuaccagcaacgcugacagagugugcacaggcaucacguccucuaauagcccccacguggucaaaaccgccacacagggggaggugaacguuaccggagugauuccucugacaaccacaccgaccaagucccauuucgcgaaucuuaaaggcacgaagacccgggggaaacugugucccaagugccucaacuguacagaucuggacgucgcucuuggacgcccuaagugcaccggcaauauccccucugccgaagugagcauucuguacgagguuagaccugugacauccggguguuuucccaucaugcacgaucggaccaaaauccgccaacucccuaaccugcugagaggauaugaacauauucggcucucuacgcacaaugucaucaacgccgagaaggcuccgggcggccccuacaaaauugggacaagcggauccugcccuaaugugaccaacggcaauggguucuuugccacaauggcuugggccgugcccaagaacgacaauaacaaaaccgcgaccaauagccugacaaucgaagucccuuauauuuguacggagggagaggaucagaucaccauuuggggcuuccauucugacaacgaaacacagauggccaagcuguacggggauuccaagccccagaaauuuaccagcucugcuaacggaguuacaacccacuaugugucccaaaucggcggcuucccgaaucagacggaggacgggggacugccucagagcggccgcaucguggucgauuacauggugcagaagucugggaaaacaggaaccauuaccuaucaaagaggcauccuccugccccagaagguuuggugcgccuccgggcggagcaaagugauuaagggaacacuuccucugaucggcgaagcugacugucuccacgagaaauacggcgggcugaacaaguccaagcccuacuauaccggagagcaugccaaagcgauuggcaauugccccaucugggucaagacaccucugaaacucgccaacgggacgaaguaccgcccgcccgcuaaacugcuuaaggaaagaggauuuuucggcgccaucgcuggguuucuggagggcggaugggaaggcaugauugccggguggcacggauauaccucucauggcgcccacgggguggcuguugcggccgaucucaagagcacacaggaggcuaucaauaaaauuaccaagaaccuuaauucccuuagcgaacuggaggugaaaaaccuccagcggcugucuggagccauggacgagcugcacaaugaaauccucgagcuggaugaaaaggucgacgaccuucgcgccgauacaauuuccagccaaaucgagcuggcugugcuccugucuaacgaaggcaucauuaauagcgaggacgagcaucuucuggcccucgaaagaaaacugaagaagaugcuggggccuuccgcggucgagaucggcaacggauguuucgaaaccaaacacaagugcaaucagacgugccucgaucggauugcugccggcaccuuugacgccggggaguucucucugcccacauuugauagccuuaacaucaccgcugccucccugaaugacgauggacucgacaaccauacaauucugcuguacuauagcaccgcugccucuucccuugcggugacgcucaugaucgccauuuucguuguguacauggucagccgcgauaacgugucuuguuccaucugccuguga

SEQ ID NO: 210007 - RNA, 1758 nt, Artificial Sequence; identical to SEQ ID NO: 209597
  derived and/or modified sequence opt5 from hemagglutinin__InfluenzaB__AGX15541

SEQ ID NO: 210008 - RNA, 1758 nt, Artificial Sequence
  derived and/or modified sequence opt5 from hemagglutinin__InfluenzaB__AGX15552
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccaaaaaugcuccgggcggccccuauaagaucgggacaagcggauccugcccuaacgucaccaauggcaacggguucuuugccacaauggcuugggccgugcccaaaaaugacaacaauaagaccgcgaccaacagccugacaauugaggugccuuacaucuguacggaaggagaggaucagauuaccgucuggggcuuccacucugacaacgagacacagauggccaaacuuuauggggauuccaagccccagaaguuuaccagcucugcuaauggaguuacaacccacuacgugucccaaaucggcggcuucccgaaccagacggaagacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaggcugacugucuccaugaaaaguauggcgggcugaauaaaucuaagcccuacuacacaggagagcacgccaaggcgauuggcaacugccccaucugggucaaaaccccucugaagcucgccaaugggacaaaauauagaccgcccgcuaagcugcuuaaagagcggggauuuuucggcgccaucgcuggguuucuggaaggcggaugggagggcaugauugccggguggcauggauacacgagccacggcgcccacgggguggcuguugcggccgaucucaaguccacccaggaagcuaucaacaagauuaccaaaaaucugaacagccuuucugagcuggaagugaagaaucuccagcgccuguccggagccauggacgagcugcauaacgagauccucgaacuggaugagaaagucgacgaccuuagagccgauacaauuagcucucaaaucgaacuggcugugcuccugagcaaugagggcaucauuaacuccgaagacgagcaccuucuggcccucgagcggaagcugaaaaagaugcuggggccuucugcggucgaaaucggcaauggauguuucgagacaaagcauaaaugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauguguccuguagcaucugccuguga

SEQ ID NO: 210009 - RNA, 1758 nt, Artificial Sequence; identical to SEQ ID NO: 209606
  derived and/or modified sequence opt5 from hemagglutinin__InfluenzaB__AGX15563

SEQ ID NO: 210010 - RNA, 1758 nt, Artificial Sequence; identical to SEQ ID NO: 209606
  derived and/or modified sequence opt5 from hemagglutinin__InfluenzaB__AGX15574

SEQ ID NO: 210011 - RNA, 1758 nt, Artificial Sequence
  derived and/or modified sequence opt5 from hemagglutinin__InfluenzaB__AGX15607
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauacacccucugccagagucagcauucugcacgaggugcggccuguuaccuccggguguuuucccaucaugcaugaucgcacgaagaucagacaacucccuaaccugcugcggggauacgaacacauucgccucucuacacauaaugugaucaacgccgagaaugcuccgggcggccccuauaaaauugggaccagcggauccugcccuaacgucacaaauggcaacggguucuuugccaccauggcuugggccgugcccaagaaugacaacaauaaaaccgcgacaaacagccugacgaucgaagugccuuacauuuguaccgagggagaggaucagaucacagucuggggcuuccacucugacaacgaaacccagauggccaaacuuuauggggauuccaagccccagaaguuuacaagcucugcuaauggaguuaccacgcacuacgugucccaaauuggcggcuucccgaaccagacagaggacgggggacugccucagagcggcagaaucguggucgauuauauggugcagaagucugggaaaaccggaaccaucacauaccaacggggcauucuccugccccagaagguuuggugcgccuccgggcgcagcaaagugaucaagggaucccuuccucugauuggcgaagcugacugucuccaugagaaauauggcgggcugaauaagucuaaacccuacuacaccggagagcacgccaaggcgaucggcaacugccccauuugggucaagacaccucugaaacucgccaaugggacgaaguauagaccgcccgcuaaacugcuuaaggaacggggauuuuucggcgccaucgcuggguuucuggagggcggaugggaaggcaugaucgccggguggcauggauacaccagccacggcgcccacgggguggcuguugcggccgaucucaaauccacacaggaggcuauuaacaagaucaccaagaaucugaacagccuuucugaacuggaggugaaaaaucuccagcgccuguccggagccauggacgagcugcauaacgaaauucucgagcuggaugaaaaggucgacgaccuuagagccgauacaaucagcucucaaauugagcuggcugugcuccugagcaaugaaggcaucaucaacuccgaggacgagcaccuucuggcccucgaacggaaacugaagaaaaugcuggggccuucugcggucgagauuggcaauggauguuucgaaaccaagcauaagugcaaccagacgugccucgaucgcaucgcugccggcaccuuugacgccggggaguucagccugcccacauuugauucccuuaauauuaccgcugccagccugaacgacgauggacucgacaaccacacaauccugcuguauuacucuaccgcugccuccagccuugcggugacgcucaugauugccaucuucguuguguauauggucucuagagauaauguguccuguagcauuugccuguga

SEQ ID NO: 210012 - RNA, 1758 nt, Artificial Sequence
  derived and/or modified sequence opt5 from hemagglutinin__InfluenzaB__AGX15629
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaauccagauggccaaacuuuauggggauuccaagccccagaaguuuacaagcucugcuaauggaguuaccacacacuacgugucccaaaucggcggcuucccgaaccagaccgaggacgggggacugccucagagcggcagaauuguggucgauuauauggugcagaagucugggaaaacgggaacaaucaccuaccaacggggcauucuccugccccagaagguuuggugcaccuccgggcgcagcaaagugaucaagggaucccuuccucugauuggcgaagccgacugucuccaugagaaauauggcgggcugaauaagucuaaacccuacuacacaggagagcacgcuaaggccaucggcaacugccccaucugggucaagaccccucugaaacucgcgaaugggacaaaguauagaccgcccgccaaacugcuuaaggaacggggauuuuucggcgcuauugccggguuucuggagggcggaugggaaggcaugaucgcuggguggcauggauacacgagccacggcgcccacgggguggccguugcugcggaucucaaauccacccaggaggccauuaacaagaucacaaagaaucugaacagccuuucugaacuggaggugaaaaaucuccagcgccuguccggagcuauggacgagcugcauaacgaaauucucgagcuggaugaaaaggucgacgaccuuagagccgauaccaucagcucucaaaucgagcuggccgugcuccugagcaaugaaggcauuaucaacuccgaggacgagcaccuucuggcucucgaacggaaacugaagaaaaugcuggggccuucugccgucgagauuggcaauggauguuucgaaacaaagcauaagugcaaccagaccugccucgaucgcaucgcggcuggcacguuugacgccggggaguucagccugcccaccuuugauucccuuaauauuacagccgcuagccugaacgacgauggacucgacaaccacaccauccugcuguauuacucuacagccgcuuccagccuugccgugacccucaugauugcgaucuucguuguguauauggucucuagagauaauguguccuguagcaucugccuguga

SEQ ID NO: 210013 - RNA, 1758 nt, Artificial Sequence
  derived and/or modified sequence opt5 from hemagglutinin__InfluenzaB__AGX15651
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugauugccaucuucgugguuuauauggugagcagagauaacgucucuuguuccaucugccuguga

SEQ ID NO: 210014 - RNA, 1758 nt, Artificial Sequence; identical to SEQ ID NO: 210013
  derived and/or modified sequence opt5 from hemagglutinin__InfluenzaB__AGX15675

SEQ ID NO: 210015 - RNA, 1758 nt, Artificial Sequence; identical to SEQ ID NO: 210013
  derived and/or modified sequence opt5 from hemagglutinin__InfluenzaB__AGX15686

SEQ ID NO: 210016 - RNA, 1758 nt, Artificial Sequence
  derived and/or modified sequence opt5 from hemagglutinin__InfluenzaB__AGX15697
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaaaccagauggccaagcuguauggggauucuaagccgcagaaauuuacauccagcgcuaacggagucaccacacacuacguuucucaaaucggcggcuucccuaaucagaccgaggacgggggacugccccaguccggcagaauugugguggauuauaugguccaaaagagcgggaaaacgggaacaaucaccuaccagcggggcauucuccugccucagaagguguggugcgccucugggcgcuccaaaguuaucaagggaagccuuccccugauuggcgaagcugacugucuccaugagaaauauggcgggcugaacaaguccaagcccuacuacaccggagagcacgccaaagcgaucggcaauugcccuaucugggugaagacaccgcugaaacucgccaacgggaccaaguauagacccccugcuaaacugcuuaaggaacggggauuuuucggcgccauugcuggguuucuggagggcggaugggaaggcaugaucgccggguggcauggauacacaucucacggcgcccacggggucgcuguggcggccgaucucaagagcacgcaggaggcuauuaauaaaaucaccaagaaccuuaauucccuuagcgaacuggagguuaaaaaccuccagcgccugucuggagccauggacgagcugcauaaugaaauucucgagcuggaugaaaagguggacgaccuuagagccgauacaaucuccagccaaaucgagcuggcuguccuccugucuaacgaaggcauuaucaauagcgaggacgagcaccuucuggcccucgaacggaaacugaagaagaugcuggggcccuccgcgguggagauuggcaacggauguuucgaaaccaaacauaagugcaaucagacaugccucgaucgcaucgcugccggcaccuuugacgccggggaguucucucugccuacguuugauagccuuaacauuaccgcugccucccugaaugacgauggacucgacaaccacacaauccugcuguauuacagcaccgcugccucuucccuugcggucacacucaugauugccaucuucgugguuuauauggugagcagagauaacgucucuuguuccaucugccuguga

SEQ ID NO: 210017 - RNA, 1758 nt, Artificial Sequence; identical to SEQ ID NO: 210013
  derived and/or modified sequence opt5 from hemagglutinin__InfluenzaB__AGX15708

SEQ ID NO: 210018 - RNA, 1758 nt, Artificial Sequence; identical to SEQ ID NO: 210013
  derived and/or modified sequence opt5 from hemagglutinin__InfluenzaB__AGX15719

SEQ ID NO: 210019 - RNA, 1758 nt, Artificial Sequence; identical to SEQ ID NO: 209538
  derived and/or modified sequence opt5 from hemagglutinin__InfluenzaB__AGX15730

SEQ ID NO: 210020 - RNA, 1758 nt, Artificial Sequence; identical to SEQ ID NO: 210013
  derived and/or modified sequence opt5 from hemagglutinin__InfluenzaB__AGX15741

SEQ ID NO: 210021 - RNA, 1758 nt, Artificial Sequence; identical to SEQ ID NO: 210013
  derived and/or modified sequence opt5 from hemagglutinin__InfluenzaB__AGX15753

SEQ ID NO: 210022 - RNA, 1758 nt, Artificial Sequence
  derived and/or modified sequence opt5 from hemagglutinin__InfluenzaB__AGX15764
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcgauuacccucaugaucgccaucuucgucguguauaugguuagcagagauaacgugucuuguuccauuugccuguga

SEQ ID NO: 210023 - RNA, 1755 nt, Artificial Sequence
  derived and/or modified sequence opt5 from hemagglutinin__InfluenzaB__AGX15775
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagauucagaugaaaaaccuguacggcgauagcaauccgcaaaaguuuacaucuuccgccaacgggguuaccacacacuaugugagccagaucggaucuuucccugaccagaccgaggauggcggccucccccaguccgggcggauuguggucgacuacaugaugcaaaagccuggaaaaacgggcacaaucguguaucagcgcgggguucugcuuccccagagaguguggugcgcuagcggacgguccaaggucaucaaaggcucucugccccucauuggggaagccgauugucugcaugagaaguacggaggccugaacaaaagcaagccuuacuauaccggcgaacacgcgaaagccaucgggaauugcccgauuugggugaagacaccccucaagcuggcuaacggaaccaaauaccgcccucccgccaagcugcugaaagagagaggcuuuuucggggcuaucgccggauuucucgagggcgggugggaaggcaugauugccggauggcacggcuauaccucccauggggcucacggaguugcgguggccgcugaccuuaagagcacacaggaggccaucaauaaaaucacgaagaaccuuaauucucuguccgaacucgaggucaagaaccugcaacggcugagcggcgccauggacgaacuccauaaugagauucuggagcuugaugaaaaaguggacgaucugcgcgcugacaccaucucuagccagauugagcucgccguccugcuuuccaacgaagggaucauuaauucugaggaugaacaucugcucgcgcuggagagaaagcugaaaaagaugcucggaccuagcgcuguggagaucggcaacggguguuucgaaacaaaacacaagugcaaucagaccugccuggaccggaucgccgccggcacauuuaacgcuggagaguucucccuucccaccuuugauagccugaauauuacggccgcuucucucaacgacgauggccuggacaaucacaccauccugcuuuacuauuccacagccgcgagcucucucgccguuacccugaugcuggcuauuuucaucguguacauggucuccagagauaacgugagcuguuccauuugccucuga

SEQ ID NO: 210024 - RNA, 1758 nt, Artificial Sequence
  derived and/or modified sequence opt5 from hemagglutinin__InfluenzaB__AGX15786
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucuuucugccuaccuucgauucucuuaauauuacagcugccagccugaacgacgauggacucgacaaucacaccauccugcuguauuacuccacagcugccagcucucuugcggucacccucaugauugccaucuucgugguuuauaugguguccagagauaacgucagcuguucuaucugccuguga

SEQ ID NO: 210025 - RNA, 1758 nt, Artificial Sequence; identical to SEQ ID NO: 210013
  derived and/or modified sequence opt5 from hemagglutinin__InfluenzaB__AGX15797

SEQ ID NO: 210026 - RNA, 1758 nt, Artificial Sequence
  derived and/or modified sequence opt5 from hemagglutinin__InfluenzaB__AGX15808
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccauugggcgcucuaaagugaucaagggaucccuuccccugauuggcgaagcugacugucuccaugagaaauauggcgggcugaauaagagcaagcccuacuacacaggagagcacgccaaagcgaucggcaacugcccuaucugggucaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucccacggcgcccacgggguggcuguugcggccgaucucaagucuacccaggaggcuauuaacaaaaucacaaagaaucugaacagccuuuccgaacuggaggugaaaaaucuccagcgccugagcggagccauggacgagcugcauaacgaaauucucgagcuggaugaaaaggucgacgaccuuagagccgauaccaucucuucccaaaucgagcuggcugugcuccugagcaaugaaggcauuaucaacucugaggacgagcaccuucuggcccucgaacggaaacugaagaagaugcuggggcccagcgcggucgagauuggcaauggauguuucgaaacaaaacauaagugcaaccagaccugccucgaucgcaucgcugccggcacguuugacgccggggaguucucccugccuaccuuugauucucuuaauauuacagcugccagccugaacgacgauggacucgacaaucacaccauccugcuguauuacuccacagcugccagcucucuugcggugacccucaugauugccaucuucguuguguauauggucuccagagauaacgugagcuguucuaucugccuguga

SEQ ID NO: 210027 - RNA, 1758 nt, Artificial Sequence; identical to SEQ ID NO: 209632
  derived and/or modified sequence opt5 from hemagglutinin__InfluenzaB__AGX15830

SEQ ID NO: 210028 - RNA, 1758 nt, Artificial Sequence; identical to SEQ ID NO: 209632
  derived and/or modified sequence opt5 from hemagglutinin__InfluenzaB__AGX15841

SEQ ID NO: 210029 - RNA, 1758 nt, Artificial Sequence; identical to SEQ ID NO: 209632
  derived and/or modified sequence opt5 from hemagglutinin__InfluenzaB__AGX15852

SEQ ID NO: 210030 - RNA, 1758 nt, Artificial Sequence; identical to SEQ ID NO: 209632
  derived and/or modified sequence opt5 from hemagglutinin__InfluenzaB__AGX15863

SEQ ID NO: 210031 - RNA, 1758 nt, Artificial Sequence
  derived and/or modified sequence opt5 from hemagglutinin__InfluenzaB__AGX15874
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccuggaucgcauugcugccggcacguuugacgccggggaguucucucuccccaccuuugauagccugaauaucacagcugccucccuuaacgacgauggacugaauaaccacaccauucuccuguauuacagcacagcugccucuucccuggcggugacccuuaugaucgccauuuucguuguguauauggucagcagagacaacgugucuuguuccaucugccucuga

SEQ ID NO: 210032 - RNA, 1758 nt, Artificial Sequence; identical to SEQ ID NO: 209632
  derived and/or modified sequence opt5 from hemagglutinin__InfluenzaB__AGX15885

SEQ ID NO: 210033 - RNA, 1758 nt, Artificial Sequence
  derived and/or modified sequence opt5 from hemagglutinin__InfluenzaB__AGX15896
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacagcccacuacgugucucaaaucggcggcuuccccaaccagaccgaggacgggggacuuccucaguccggcagaaucguggucgauuauauggugcaaaagagcgggaaaacgggaacaauuaccuaccagcggggcauccugcucccccagaagguuuggugcgcuucugggcgcuccaaagugauuaagggaagccugccccuuaucggcgaagccgacugucugcaugagaaauauggcgggcucaauaaguccaagccuuacuacaccggagagcacgcgaaagccauuggcaacugcccgaucugggucaagacaccccugaaacuggcuaaugggaccaaguauagaccucccgccaaacuccugaaggaacggggauuuuucggcgcuaucgccggguuucuugagggcggaugggaaggcaugauugccggguggcauggauacacaucucacggcgcucacgggguggcgguugccgcugaucucaagagcacgcaggaggccaucaacaaaauuaccaagaaucugaacucccugagcgaacuugaggugaaaaaucugcagcgccucucuggagccauggacgagcugcauggcgaaauccuggagcucgaugaaaaggucgacgaccugagagcugauacaauuuccagccaaaucgagcuugccgugcugcucucuaacgaagggaucauuaauagcgaggacgagcaucugcuugcgcuggaacggaaacucaagaagaugcugggcccuuccgcugucgagaucggaaacggcuguuucgaaaccaaacacaagugcaaucagacaugccuggaucgcauugccgccgggaccuuugacgcuggagaguucucucuccccacguuugauagccugaacaucaccgccgcuucccuuaaugacgauggccuggacaaccacacaauucuccuguauuacagcaccgccgcgucuucccuggccgugacacuuaugaucgcuauuuucguuguguauauggucagcagagauaaugugucuuguuccaucugccucuga

SEQ ID NO: 210034 - RNA, 1758 nt, Artificial Sequence; identical to SEQ ID NO: 209632
  derived and/or modified sequence opt5 from hemagglutinin__InfluenzaB__AGX15907

SEQ ID NO: 210035 - RNA, 1758 nt, Artificial Sequence; identical to SEQ ID NO: 209632
  derived and/or modified sequence opt5 from hemagglutinin__InfluenzaB__AGX15918

SEQ ID NO: 210036 - RNA, 1758 nt, Artificial Sequence
  derived and/or modified sequence opt5 from hemagglutinin__InfluenzaB__AGX15929
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgaacaaugugauuaacgccgagaaugcuccgggcggccccuauaagaucgggacaagcggauccugcccuaacgucaccaauggcaacggguucuuugccacaauggcuugggccgugcccaaaaaugacaagaacaaaaccgcgaccaauccucugacaauugaagugcccuacaucuguacggagggagaggaucagauuaccgucuggggcuuccauagcgacaacgaaacacagauggccaagcuguauggggauucuaagccgcagaaauuuaccuccagcgcuaacggaguuacaacccacuacgugucucaaaucggcggcuucccuaaucagacggaggacgggggacugccccaguccggcagaaucguggucgauuauauggugcagaaaagcgaaaagacagggaccauuaccuaccaacggggaauccuccugccucagaagguuuggugcgccucuggccgcuccaaagugauuaaggggagccuuccccugaucggagaggcugacugucuccacgagaaauauggcggccugaacaaguccaagcccuacuacacaggggaacaugccaaagcgauuggaaauugcccuaucugggucaagaccccgcugaaacucgccaacggcacaaaguauagacccccugcuaaacugcuuaaggagcggggguuuuucggagccaucgcuggcuuucuggaagggggcugggagggaaugauugccggcuggcacggguacacgucucauggagcccacggcguggcuguugcggccgaucucaagagcacccaggaagcuaucaauaaaauuacaaagaaccuuaauucccuuagcgagcuggaggugaaaaaccuccagcgccugucuggggccauggacgaacugcacaaugagauccucgaacuggaugagaaggucgacgaccuuagagccgauaccauuuccagccaaaucgaacuggcugugcuccugucuaacgagggaaucauuaauagcgaggacgaacaucuucuggcccucgagcggaaacugaagaagaugcugggccccuccgcggucgaaaucgggaacggcuguuucgagacaaaacacaagugcaaucagaccugccucgaucgcauugcugccggaacguuugacgccggcgaguucucucugccuaccuuugauagccuuaacaucacagcugccucccugaaugacgaugggcucgacaaccauaccauucugcuguauuacagcacagcugccucuucccuugcggugacccucaugaucgccauuuucguuguguauauggucagcagagauaacgugucuuguuccaucugccuguga

SEQ ID NO: 210037 - RNA, 1758 nt, Artificial Sequence; identical to SEQ ID NO: 209632
  derived and/or modified sequence opt5 from hemagglutinin__InfluenzaB__AGX15940

SEQ ID NO: 210038 - RNA, 1758 nt, Artificial Sequence
  derived and/or modified sequence opt5 from hemagglutinin__InfluenzaB__AGX15962
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacaacccacuacgucucucaaauuggcggcuucccuaaccagacggaggacgggggacugccccaguccggcagaaucguuguggauuauaugaugcaaaagagcgggaaaacaggaaccauuaccuaccagcggggcauccuccugccucagaagguguggugcgccucugggcgcuccaaagucauuaagggaagccuuccccugaucggcgaagcugacugucuccaugagaaauauggcgggcugaauaaguccaagcccuacuacacaggagagcacgccaaagcgaucggcaacugcccuauuugggugaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguugcuguggcggccgaucucaagagcacccaggaggcuaucaacaaaauuacaaagaaucugaacucccuuagcgaacuggaggucaaaaaucuccagcgccugucuggagccauggacgagcugcauaacgaaauccucgagcuggaugaaaagguggacgaccuuagagccgauaccaucuccagccaaauugagcuggcuguucuccugucuaaugaaggcaucauuaacagcgaggacgagcaccuucuggcccucgaacggaaacugaagaagaugcuggggcccuccgcgguggagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggucacccucaugaucgccaucuucguggucuauauggugagcagagauaacguuucuuguuccauuugccuguga

SEQ ID NO: 210039 - RNA, 1758 nt, Artificial Sequence; identical to SEQ ID NO: 209669
  derived and/or modified sequence opt5 from hemagglutinin__InfluenzaB__AGX15973

SEQ ID NO: 210040 - RNA, 1758 nt, Artificial Sequence; identical to SEQ ID NO: 209669
  derived and/or modified sequence opt5 from hemagglutinin__InfluenzaB__AGX15984

SEQ ID NO: 210041 - RNA, 1758 nt, Artificial Sequence; identical to SEQ ID NO: 209707
  derived and/or modified sequence opt5 from hemagglutinin__InfluenzaB__AGX15995

SEQ ID NO: 210042 - RNA, 1758 nt, Artificial Sequence; identical to SEQ ID NO: 209707
  derived and/or modified sequence opt5 from hemagglutinin__InfluenzaB__AGX16006

SEQ ID NO: 210043 - RNA, 1758 nt, Artificial Sequence
  derived and/or modified sequence opt5 from hemagglutinin__InfluenzaB__AGX16017
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaauucagauggccaaacuuuauggggauucuaagccgcagaaguuuacauccagcgcuaacggagugaccacacacuacgucucucaaaucggcggcuucccuaaccagaccgaggacgggggacugccccaguccggcagaauuguuguggauuauauggugcaaaagagcgggaaaacgggaacaaucaccuaccagcggggcauucuccugccucagaaggucuggugcgccucugggcgcuccaaagugaucaagggaagccuuccccugaucggcgaagcugacugucuccaugagaaauauggcgggcugaauaaguccaagcccuacuacaccggagagcacgccaaagcgauuggcaacugcccuaucuggguuaagacaccgcugaaacucgccaaugggaccaaguauagacccccugcuaaacugcuuaaggaacggggauuuuucggcgccauugcuggguuucuggagggcggaugggaaggcaugaucgccggguggcauggauacacaucucacggcgcccacgggguggcugucgcggccgaucucaagagcacgcaggaggcuauuaacaaaaucaccaagaaucugaacucccuuagcgaacuggaggugaaaaaucuccagcgccugucuggagccauggacgagcugcauaacgaaauccucgagcuggaugaaaagguugacgaccuuagagccgauacaauuuccagccaaaucgagcuggcugugcuccugucuaaugaaggcauuaucaacagcgaggacgagcaccuucuggcccucgaacggaaacugaagaagaugcuggggcccuccgcggucgagauuggcaauggauguuucgaaaccaaacauaagugcaaccagacaugccucgaucgcaucgcugccggcaccuuugacgccggggaguucucucugccuacguuugauagccuuaauauuaccgcugccucccugaacgacgauggacucgacaaucacacaauccugcuguauuacagcaccgcugccucuucccuugcggugacacucaugaucgccauuuucgucguguauaugguuagcagagauaacgugucuuguuccaucugccuguga

SEQ ID NO: 210044 - RNA, 1755 nt, Artificial Sequence; identical to SEQ ID NO: 209450
  derived and/or modified sequence opt5 from hemagglutinin__InfluenzaB__AGX16028

SEQ ID NO: 210045 - RNA, 1755 nt, Artificial Sequence
  derived and/or modified sequence opt5 from hemagglutinin__InfluenzaB__AGX16039
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggaaggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcaaagacuguccggggccguggacgaacuccauaaugagauccuggagcuugaugaaaaggucgacgaucugcgggcugacacaauuagcucucagaucgagcucgccgugcugcuuagcaacgaaggaauuaucaauuccgaggaugaacaucugcucgcgcuggagcgcaaacugaagaaaaugcucggcccuucugcuguugacauugggaacggcuguuucgagaccaagcacaagugcaaucagacaugccuggauagaaucgccgccggaaccuuuaacgcuggcgaguucagccuucccacguuugacucccugaauaucaccgccgcuagccucaacgaugacgggcuggauaaucacacaauucugcuuuacuauucuaccgccgcguccagccucgccgugacacugaugcuggcuaucuucauugucuacauggugucucgggacaacguuuccuguagcaucugccucuga

SEQ ID NO: 210046 - RNA, 1755 nt, Artificial Sequence
  derived and/or modified sequence opt5 from hemagglutinin__InfluenzaB__AGX16050
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuauauuuguacggaaggggaggaucagaucaccgucuggggauuccauuccgacaacaaaacacagaugaagaaucuguacggcgauagcaacccgcaaaaauuuaccucuuccgccaacgggguuacaacccacuaugugagccagauuggaggcuucccugcucagacggaggacggcgggcucccccagucuggacggaucguggucgauuacauggugcaaaagccucgcaagacaggcaccauuguuuaucagagaggggugcugcuuccccagaaagucuggugcgccuccggacggagcaaggugaucaaaggcucccugccccucaucggggaagcggacugucugcaugagaaguacggaggccugaauaaaucuaagccuuacuauaccggcgaacacgccaaagcuauugggaacugcccgaucuggguuaagacaccccucaagcuggccaauggaaccaaauaccgcccucccgcuaagcugcugaaagagagaggcuuuuucggggccauugccggauuucucgagggcgggugggaaggcaugaucgcuggauggcacggcuauacaagccauggggcgcacggaguggccgucgcugccgaucugaaguccacgcaggaggccauuaacaaaaucaccaagaaucuuaacagccugucugaacucgaggugaagaaucugcaacggcuguccggcgcuauggacgaacuccauaacgagauccuggagcuugacgaaaaagucgaugaccugcgcgccgauacaauuagcucucagaucgagcucgcggugcugcuuagcaaugaagggauuaucaacuccgaggacgaacaccuucucgcucuggagagaaagcugaaaaagaugcucggaccuucugccguugauauuggcaauggguguuucgagaccaaacacaagugcaaccagacaugccuggaccggaucgccgcuggcaccuuuaaugccggagaguucagccuucccacguuugauucccugaacaucaccgcugccagccucaaugacgauggccuggacaaccauacaauucugcuuuacuauucuaccgcggccuccagccucgcugugacacugaugcuggccaucuucauugucuacauggugucuagagauaacguuuccuguagcaucugccucuga

SEQ ID NO: 210047 - RNA, 1755 nt, Artificial Sequence
  derived and/or modified sequence opt5 from hemagglutinin__InfluenzaB__AGX16061
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggaaggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcaaagacuguccggggccauggacgaacuccauaaugagauccuggagcuugaugaaaagguggacgaucugcgggcugacacaauuagcucucagaucgagcucgccguccugcuuagcaacgaaggaauuaucaauuccgaggaugaacaucugcucgcgcuggagcgcaaacugaagaaaaugcucggcccuucugcuguggacauugggaacggcuguuucgagaccaagcacaagugcaaucagacaugccuggauagaaucgccgccggaaccuuuaacgcuggcgaguucagccuucccacguuugacucccugaauaucaccgccgcuagccucaacgaugacgggcuggauaaucacacaauucugcuuuacuauucuaccgccgcguccagccucgccguuacacugaugcuggcuaucuucauuguguacauggucucucgggacaacguguccuguagcaucugccucuga

SEQ ID NO: 210048 - RNA, 1755 nt, Artificial Sequence
  derived and/or modified sequence opt5 from hemagglutinin__InfluenzaB__AGX16083
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggagggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcaaagacuguccggggccauggacgaacuccauaaugagauccuggagcuugaugaaaagguggacgaucugcgggcugacacaauuagcucucagaucgagcucgccguccugcuuagcaacgaaggaauuaucaauuccgaggaugaacaucugcucgcgcuggagcgcaaacugaagaaaaugcucggcccuucugcuguggagauugggaacggcuguuucgaaaccaagcacaagugcaaucagacaugccuggacagaaucgccgccggaaccuuuaacgcuggcgaguucagccuucccacguuugauucccugaauaucaccgccgcuagccucaacgacgaugggcuggacaaucacacaauucugcuuuacuauucuaccgccgcguccagccucgccguuacacugaugcuggcuaucuucauuguguacauggucucucgggauaacguguccuguagcaucugccucuga

SEQ ID NO: 210049 - RNA, 1755 nt, Artificial Sequence
  derived and/or modified sequence opt5 from hemagglutinin__InfluenzaB__AGX16105
augaaggccaucauugugcugcucauggucguuaccagcaacgcugacagaaucugcacaggcauuacguccucuagcucuccccacguggugaaaaccgccacacagggggaggucaaugugaccggaguuaucccucugacaaccacaccgaccaaguccuacuucgcgaaccuuaaaggcacgcggacccgcgggaagcugugucccgauugccucaauuguacagaccuggauguggcucuuggaagaccuaugugcgucggcaccacacccagcgccaaagccuccauucugcaugaagugcggccuguuaccucuggguguuuucccaucaugcacgaccgcacgaagaucagacaacucccuaaccugcugcggggauaugagaauauucgccucagcacacagaacgugaucgaugcugaaaaggccccgggcggccccuacagacuggggaccuccggaagcugcccuaaugcuacaucuaaauccggcuucuuugccaccauggcgugggccguccccaaggacaacaauaaaaacgcuaccaauccucuuacaguggaggugcccuauauuuguacggaaggggaggaucagaucaccgucuggggauuccauagcgacaacaagacacagaugaaaaaucuguacggcgauucuaacccgcaaaaguuuaccuccagcgccaaugggguuacaacccacuaugugucucagauuggaggcuucccugaccagacggaggauggcgggcucccccaguccggacggaucguggucgacuacaugaugcaaaagccuggcaaaacagggaccauuguguaucagcgcggaguucugcuuccccagaagguguggugcgcuagcggcagauccaaagucaucaaggggucucugccccucaucggagaagccgauugucugcaugagaaauacggcggccugaacaagagcaaaccuuacuauaccggggaacacgcgaaggccauuggaaacugcccgaucugggugaagacaccccucaaacuggcuaauggcaccaaguaccggccucccgccaaacuucugaaggagcgcggguuuuucggagcuauugccggcuuucucgaagggggcugggaaggaaugaucgccggcuggcacggguauacaucccauggagcucacggcguugcgguggccgcugaccugaaaagcacgcaggaggccauuaacaagaucaccaagaaucuuaacucucuguccgaacucgaggucaaaaaucugcaaagacugagcggggccauggacgaacuccauucugagauccuggagcuugaugaaaagguggacgaucugcgggcugacacaauuagcucccagaucgagcucgccguccugcuuucuaacgaaggaauuaucaauagcgaggaugaacaucugcucgcgcuggagcgcaaacugaagaaaaugcucggcccuuccgcuguggacauugggaacggcuguuucgagaccaagcacaagugcaaucagacaugccuggauagaaucgccgccggaaccuuuaacgcuggcgaguucagccuucccacguuugacucucugaauaucaccgccgcuucccucaacgaugacgggcuggauaaucacacaauucugcuuuacuauagcaccgccgcgucuucccucgccguuacacugaugcuggcuaucuucauuguguacauggucagccgggacaacguguccuguucuaucugccucuga

SEQ ID NO: 210050 - RNA, 1755 nt, Artificial Sequence
  derived and/or modified sequence opt5 from hemagglutinin__InfluenzaB__AGX16116
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaacacagaugaagaaucuguacggcgauagcaacccgcaaaaauuuaccucuuccgccaacggggugacaacccacuaugugagccagaucggaggcuucccugcucagacggaggacggcgggcucccccagucuggacggauugucguggauuacaugguucaaaagccucgcaagacaggcaccaucguguaucagagagggguccugcuuccccagaaaguguggugcgccuccggacggagcaagguuauuaaaggcucccugccccucaucggggaagcggacugucugcaugagaaguacggaggccugaauaaaucuaagccuuacuauaccggcgaacacgccaaagcuaucgggaacugcccgauuugggugaagacaccccucaagcuggccaauggaaccaaauaccgcccucccgcuaagcugcugaaagagagaggcuuuuucggggccaucgccggauuucucgagggcgggugggaaggcaugauugcuggauggcacggcuauacaagccauggggcgcacggagucgccguggcugccgaucugaaguccacgcaggaggccaucaacaaaauuaccaagaaucuuaacagccugucugaacucgagaucaagaaucugcaacggcuguccggcgcuauggacgaacuccauaacgagauccuggagcuugacgaaaaagucgaugaccugcgcgccgauacaauuagcucucagaucgagcucgcggugcugcuuagcaaugaagggauuaucaacuccgaggacgaacaccuucucgcucuggagagaaagcugaaaaagaugcucggaccuucugccguugauauuggcaauggguguuucgagaccaaacacaagugcaaccagacaugccuggaccggaucgccgcuggcaccuuuaaugccggagaguucagccuucccacguuugauucccugaacaucaccgcugccagccucaaugacgauggccuggacaaccauacaauucugcuuuacuauucuaccgcggccuccagccucgcugugacacugaugcuggccaucuucauugucuacauggugucuagagauaacguuuccuguagcaucugccucuga

SEQ ID NO: 210051 - RNA, 1755 nt, Artificial Sequence
  derived and/or modified sequence opt5 from hemagglutinin__InfluenzaB__AGX16127
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaauccagaugaagaaucuguacggcgauagcaacccgcaaaaauuuacaucuuccgccaacggggugaccacacacuaugugagccagauuggaggcuucccugcucagaccgaggacggcgggcucccccagucuggacggaucgucguggauuacaugguucaaaagccucgcaagacgggcacaauuguguaucagagagggguccugcuuccccagaaaguguggugcgccuccggacggagcaagguuaucaaaggcucccugccccucaucggggaagcggacugucugcaugagaaguacggaggccugaauaaaucuaagccuuacuauaccggcgaacacgccaaagcuauugggaacugcccgaucugggugaagacaccccucaagcuggccaauggaaccaaauaccgcccucccgcuaagcugcugaaagagagaggcuuuuucggggccauugccggauuucucgagggcgggugggaaggcaugaucgcuggauggcacggcuauaccagccauggggcgcacggagucgccguggcugccgaucugaaguccacacaggaggccauuaacaaaaucacgaagaaucuuaacagccugucugaacucgagaucaagaaucugcaacggcuguccggcgcuauggacgaacuccauaacgagauucuggagcuugacgaaaaagucgaugaccugcgcgccgauaccaucagcucucagauugagcucgcggugcugcuuagcaaugaagggaucauuaacuccgaggacgaacaccuucucgcucuggagagaaagcugaaaaagaugcucggaccuucugccguugauaucggcaauggguguuucgagacaaaacacaagugcaaccagaccugccuggaccggaucgccgcuggcacauuuaaugccggagaguucagccuucccaccuuugauucccugaacauuacggcugccagccucaaugacgauggccuggacaaccauaccauccugcuuuacuauucuacagcggccuccagccucgcugugacccugaugcuggccauuuucaucgucuacauggugucuagagauaacguuuccuguagcauuugccucuga

SEQ ID NO: 210052 - RNA, 1755 nt, Artificial Sequence; identical to SEQ ID NO: 210050
  derived and/or modified sequence opt5 from hemagglutinin__InfluenzaB__AGX16138

SEQ ID NO: 210053 - RNA, 1755 nt, Artificial Sequence; identical to SEQ ID NO: 210047
  derived and/or modified sequence opt5 from hemagglutinin__InfluenzaB__AGX16149

SEQ ID NO: 210054 - RNA, 1755 nt, Artificial Sequence; identical to SEQ ID NO: 210048
  derived and/or modified sequence opt5 from hemagglutinin__InfluenzaB__AGX16160

SEQ ID NO: 210055 - RNA, 1755 nt, Artificial Sequence; identical to SEQ ID NO: 210048
  derived and/or modified sequence opt5 from hemagglutinin__InfluenzaB__AGX16182

SEQ ID NO: 210056 - RNA, 1755 nt, Artificial Sequence; identical to SEQ ID NO: 209450
  derived and/or modified sequence opt5 from hemagglutinin__InfluenzaB__AGX16193

SEQ ID NO: 210057 - RNA, 1755 nt, Artificial Sequence; identical to SEQ ID NO: 209450
  derived and/or modified sequence opt5 from hemagglutinin__InfluenzaB__AGX16215

SEQ ID NO: 210058 - RNA, 1755 nt, Artificial Sequence; identical to SEQ ID NO: 209450
  derived and/or modified sequence opt5 from hemagglutinin__InfluenzaB__AGX16226

SEQ ID NO: 210059 - RNA, 1755 nt, Artificial Sequence
  derived and/or modified sequence opt5 from hemagglutinin__InfluenzaB__AGX16237
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggaaggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcaaagacuguccggggccauggacgaacuccauaaugagauccuggagcuugaugaaaagguggacgaucugcgggcugacacaauuagcucucagaucgagcucgccguccugcuuagcaacgaaggaauuaucaauuccgaggaugaacaucugcucgcgcuggagcgcaaacugaagaaaaugcucggcccuucugcuguggacauugggaacggcuguuucgagaccaagcacaagugcaaucagacaugccuggauagaaucgccgccggaaccuuuaacgcuggcgaguucagccuucccacguuugacucccugaauaucaccgccgcuagccucaacgaugacgggcuggauaaucacacaauucugcuuuacuauucuaccgccgcguccagccucgccaucacacugaugcuggcuauuuucaucguuuacauggugucucgggacaacgucuccuguagcauuugccucuga

SEQ ID NO: 210060 - RNA, 1755 nt, Artificial Sequence; identical to SEQ ID NO: 209450
  derived and/or modified sequence opt5 from hemagglutinin__InfluenzaB__AGX16248

SEQ ID NO: 210061 - RNA, 1755 nt, Artificial Sequence; identical to SEQ ID NO: 209450
  derived and/or modified sequence opt5 from hemagglutinin__InfluenzaB__AGX16259

SEQ ID NO: 210062 - RNA, 1755 nt, Artificial Sequence
  derived and/or modified sequence opt5 from hemagglutinin__InfluenzaB__AGX16270
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaaggaaggggaggaucagaucacggucuggggauuccauuccgacaauaaaacccagaugaagaaccuguacggcgauagcaauccccaaaaguuuacaucuuccgcuaacgggguuaccacacacuaugugagccagauuggaggcuucccggaccagaccgaggauggcgggcucccucagucuggacggaucguggucgacuacaugauucaaaaacccggcaagacggggacaaucguguaucagcgcggaguucugcuuccucagaaaguguggugcgccuccggcagaagcaaggucaucaaagggucccugccccucauuggagaagcggauugucugcaugagaaguacggcggccugaacaaaucuaagcccuacuauaccggggaacacgccaaggcuaucggaaauugcccuauuugggugaaaaccccgcucaagcuggccaacggcacaaaauaccggcccccugcuaagcugcugaaagagcgcggguuuuucggagccaucgccggcuuucucgaagggggcugggaaggaaugauugcuggcuggcacggguauaccagccauggagcgcacggcguugccguggcugccgaccugaaguccacacaggaggccaucaauaagaucacgaaaaaccuuaauagccugucugaacucgaggucaagaaccugcaaagacuguccggggcuauggacgaacuccauaaugagauucuggagcuugaugaaaaaguggacgaucugcgggccgacaccaucagcucucagauugagcucgcgguccugcuuagcaacgaaggaaucauuaauuccgaggaugaacaccuucucgcucuggagcgcaagcugaaaaagaugcucggccccucugccguggacaucgggaacggcuguuucgagacaaagcacaaaugcaaucagaccugccuggauagaaucgccgcuggaacauuuaacgccggcgaguucagccuuccuaccuuugacucccugaauauuacggcugccagccucaacgaugacgggcuggauaaucauaccauccugcuuuacuauucuacagcggccuccagccucgcuguuacccugaugcuggccauuuucaucguguacauggucucucgggacaacguguccuguagcauuugccucuga

SEQ ID NO: 210063 - RNA, 1755 nt, Artificial Sequence; identical to SEQ ID NO: 210062
  derived and/or modified sequence opt5 from hemagglutinin__InfluenzaB__AGX16281

SEQ ID NO: 210064 - RNA, 1755 nt, Artificial Sequence
  derived and/or modified sequence opt5 from hemagglutinin__InfluenzaB__AGX16292
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuaaucagaacgugaucgaugccgaaaaggcuccuggcggcccguacagacuggggacaagcggauccugccccaaugccaccagcaaaucuggcuucuuugcgacaauggccugggcugucccuaaggacaacaauaaaaacgccaccaauccccuuaccguggaggugccuuauauuuguacagaaggggaggaucagaucacggucuggggauuccauuccgacaacaagacccagaugaaaaaucuguacggcgauagcaacccccaaaaguuuacaucuuccgcuaacgggguuaccacacacuaugugagccagauuggaggcuucccggaccagaccgaggauggcgggcucccucagucuggacggaucguggucgacuacaugaugcaaaagcccggcaaaacggggacaauuguguaucagcgcggaguucugcuuccucagaagguguggugcgccuccggcagaagcaaagucaucaagggggcgcugccccucaucggagaagccgauugucugcaugagaaauacggcggccugaauaaguccaaacccuacuauaccggggaacacgcuaaggccauuggaaacugcccuaucugggugaagaccccgcucaaacuggcuaauggcacaaaguaccggcccccugccaaacuucugaaggagcgcggguuuuucggagccauugcuggcuuucucgaagggggcugggaaggaaugaucgcgggcuggcacggguauaccucucauggagcccacggcguugcuguggccgccgaccugaaaagcacacaggaggcuauuaacaagaucacgaagaaucuuaacucccugagcgaacucgaggucaaaaaucugcaaagacugucuggggccauggacgaacuccauaacgagauccuggagcuugaugaaaagguggacgaucugcgggcggacaccauuuccagccagaucgagcucgcuguccugcuuucuaaugaaggaauuaucaacagcgaggaugaacaucugcucgcccuggagcgcaaacugaagaaaaugcucggccccuccgccguggacauugggaauggcuguuucgagacaaagcacaagugcaaccagaccugccuggauagaaucgcugccggaacauuuaaugcuggcgaguucucucuuccuaccuuugacagccugaacaucacggccgcgucccucaaugaugacgggcuggauaaccacaccauucugcuuuacuauagcacagccgcuucuucccucgccguuacccugaugcuggcuaucuucauuguguacauggucagccgggacaacgugucuuguuccaucugccucuga

SEQ ID NO: 210065 - RNA, 1758 nt, Artificial Sequence; identical to SEQ ID NO: 209538
  derived and/or modified sequence opt5 from hemagglutinin__InfluenzaB__AGX16303

SEQ ID NO: 210066 - RNA, 1755 nt, Artificial Sequence; identical to SEQ ID NO: 209450
  derived and/or modified sequence opt5 from hemagglutinin__InfluenzaB__AGX16314

SEQ ID NO: 210067 - RNA, 1755 nt, Artificial Sequence; identical to SEQ ID NO: 209450
  derived and/or modified sequence opt5 from hemagglutinin__InfluenzaB__AGX16325

SEQ ID NO: 210068 - RNA, 1755 nt, Artificial Sequence; identical to SEQ ID NO: 209755
  derived and/or modified sequence opt5 from hemagglutinin__InfluenzaB__AGX16336

SEQ ID NO: 210069 - RNA, 1755 nt, Artificial Sequence; identical to SEQ ID NO: 209755
  derived and/or modified sequence opt5 from hemagglutinin__InfluenzaB__AGX16347

SEQ ID NO: 210070 - RNA, 1755 nt, Artificial Sequence; identical to SEQ ID NO: 209755
  derived and/or modified sequence opt5 from hemagglutinin__InfluenzaB__AGX16358

SEQ ID NO: 210071 - RNA, 1755 nt, Artificial Sequence
  derived and/or modified sequence opt5 from hemagglutinin__InfluenzaB__AGX16369
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaucuuucccugaccagacggaggauggcggccucccccaguccgggcggaucguggucgacuacaugaugcaaaagccuggaaaaacaggcaccauuguguaucagcgcgggauccugcuuccccagaagguuuggugcgcuagcggaagauccaaagugaucaagggcucucugccccucauuggggaagccgauugucugcaugagaaauacggaggccugaacaagagcaaaccuuacuauaccggcgaacacgcgaaggccaucgggaauugcccgauuugggucaagacaccccucaaacuggcuaacggaaccaaguaccggccucccgccaaacuucugaaggagcgcggcuuuuucggggcuaucgccggauuucucgagggcgggugggaaggcaugauugccggauggcacggcuauacaucccauggggcucacggaguggcgguugccgcugaccugaaaagcacgcaggaggccaucaauaagaucaccaagaaccuuaauucucuguccgaacucgaggugaaaaaccugcaaagacugagcggcgccauggacgaacuccauaaugagauucuggagcuugaugaaaaggucgacgaucugcgggcugacacaaucucuagccagauugagcucgccgugcugcuuuccaacgaagggaucauuaauucugaggaugaacaucugcucgcgcuggagcgcaaacugaagaaaaugcucggaccuagcgcugucgagaucggcaacggguguuucgaaaccaagcacaagugcaaucagacaugccuggacagaaucgccgccggcaccuuuaacgcuggagaguucucccuucccacguuugauagccugaauauuaccgccgcuucucucaacgacgauggccuggacaaucacacaauccugcuuuacuauuccaccgccgcgagcucucucgccgugacacugaugcuggcuauuuucaucguuuacauggugucccgggauaacgucagcuguuccauuugccucuga

SEQ ID NO: 210072 - RNA, 1755 nt, Artificial Sequence
  derived and/or modified sequence opt5 from hemagglutinin__InfluenzaB__AGX16380
augaaggccaucgugguccugcucaugguugugaccagcaacgcugacagaauuugcacaggcaucacguccucuaauagcccccacguggucaaaaccgccacacagggggaggugaacguuaccggagugauuccucugacaaccacaccgaccaaguccuacuucgcgaaucuuaaaggcacgcggacccgcgggaagcugugucccgauugccucaacuguacagaccuggaugucgcucuuggaagaccuaugugcgugggcgccacccccucugccaaagcuagcauccugcaugaaguucggccugugacauccggguguuuucccaugaugcacgaccgcaccaagauuagacaacucccuaaucugcugcggggauaugagaacauccgccucucuacgcagaaugucaucgaugccgaaaaggcuccgggcggccccuacagacuggggacaagcggauccugcccuaacgccaccagcaaaucuggcuucuuugcgacaauggccugggcugugcccaaggacaauaacaaaaaugccaccaacccucuuaccguggagguccccuauauuuguacagaaggggaggaucagaucacgguuuggggauuccauuccgacaauaagacccagaugaaaaaccuguacggcgauagcaauccgcaaaaguuuacaucuuccgcuaacggggugaccacacacuaugugagccagauuggaucuuucccugaccagaccgaggauggcggccucccccaguccgggcggaucgucguggacuacaugaugcaaaagccuggaaaaacgggcacaauuguuuaucagcgcggggugcugcuuccccagaaggucuggugcgccagcggaagauccaaagugaucaagggcucucugccccucauuggggaagcggauugucugcaugagaaauacggaggccugaacaagagcaaaccuuacuauaccggcgaacacgccaaggcuaucgggaauugcccgaucuggguuaagacaccccucaaacuggccaacggaaccaaguaccggccucccgcuaaacuucugaaggagcgcggcuuuuucggggccauugccggauuucucgagggcgggugggaaggcaugaucgcuggauggcacggcuauaccucccauggggcgcacggaguggccgucgcugccgaccugaaaagcacacaggaggccauuaauaagaucacgaagaaccuuaauucucuguccgaacucgaggugaaaaaccugcaaagacugagcggcgcuauggacgaacuccauaaugagauucuggagcuugaugaaaaggucgacgaucugcgggccgacaccaucucuagccagaucgagcucgcggugcugcuuuccaacgaagggauuaucaauucugaggaugaacaucugcucgcucuggagcgcaaacugaagaaaaugcucggaccuagcgccguugagauuggcaacggguguuucgaaacaaagcacaagugcaaucagaccugccuggacagaaucgccgcuggcacauuuaacgccggagaguucucccuucccaccuuugauagccugaauauuacggcugccucucucaacgacgauggccuggacaaucacaccauccugcuuuacuauuccacagcggccagcucucucgcugugacccugaugcuggccaucuucauugucuacauggugucccgggauaacguuagcuguuccaucugccucuga

SEQ ID NO: 210073 - RNA, 1755 nt, Artificial Sequence; identical to SEQ ID NO: 209591
  derived and/or modified sequence opt5 from hemagglutinin__InfluenzaB__AGX16391

SEQ ID NO: 210074 - RNA, 1755 nt, Artificial Sequence
  derived and/or modified sequence opt5 from hemagglutinin__InfluenzaB__AGX16402
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagccgcagaugaaaaaucuguauggcgauuccaacccucaaaaguuuacaagcucugccaaugggguuaccacacacuacgugucccagaucggagacuuccccgaucagaccgaggacggcggccucccucagagcgggcggauuguggucgauuauaugaugcaaaagcccggaaaaacgggcacaaucguguaccagcgcgggguucugcuuccccagaagguguggugcgcuucuggaagauccaaagucaucaagggcagccugccucucauuggggaagccgacugucugcaugagaaauacggaggccugaacaaguccaaaccguauuacaccggcgaacacgcgaaggccaucgggaacugccccauuugggugaagaccccucucaaacuggcuaauggaacaaaguaucggcccccugccaaacuucugaaggagcgcggcuuuuucggggcuaucgccggauuucucgagggcgggugggaaggcaugauugccggauggcacggcuacaccucucauggggcucacggaguugcgguggccgcugaccugaaaagcacacaggaggccaucaacaagaucacgaagaaucuuaacucccugagcgaacucgaggucaaaaaucugcaaagacugucuggcgccauggaugaacuccauaacgagauucuggagcuugacgaaaagguggaugaccugcgggcugauaccaucuccagccagauugagcucgccguccugcuuucuaaugaagggaucauuaacagcgaggacgaacaucugcucgcgcuggagcgcaaacugaagaaaaugcucggacccuccgcuguggauaucggcaauggguguuucgagacaaagcacaagugcaaccagaccugccuggacagaaucgccgccggcacauuuaaugcuggagaguucucucuuccgaccuuugauagccugaacauuacggccgcuucccucaaugacgauggccuggacaaccacaccauccugcuuuauuacagcacagccgcgucuucccucgccguuacccugaugcuggcuauuuucaucguguauauggucagccgggacaaugugucuuguuccauuugccucuga

SEQ ID NO: 210075 - RNA, 1755 nt, Artificial Sequence; identical to SEQ ID NO: 209844
  derived and/or modified sequence opt5 from hemagglutinin__InfluenzaB__AGX16413

SEQ ID NO: 210076 - RNA, 1755 nt, Artificial Sequence; identical to SEQ ID NO: 209844
  derived and/or modified sequence opt5 from hemagglutinin__InfluenzaB__AGX16423

SEQ ID NO: 210077 - RNA, 1755 nt, Artificial Sequence; identical to SEQ ID NO: 209844
  derived and/or modified sequence opt5 from hemagglutinin__InfluenzaB__AGX16434

SEQ ID NO: 210078 - RNA, 1755 nt, Artificial Sequence; identical to SEQ ID NO: 209844
  derived and/or modified sequence opt5 from hemagglutinin__InfluenzaB__AGX16445

SEQ ID NO: 210079 - RNA, 1755 nt, Artificial Sequence; identical to SEQ ID NO: 209844
  derived and/or modified sequence opt5 from hemagglutinin__InfluenzaB__AGX16456

SEQ ID NO: 210080 - RNA, 1755 nt, Artificial Sequence
  derived and/or modified sequence opt5 from hemagglutinin__InfluenzaB__AGX16467
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaucuuucccugaccagacggaggauggcggccucccccaguccgggcggaucguggucgacuacaugaugcaaaagccuggaaaaacaggcaccauuguguaucagcgcgggguucugcuuccccagagaguguggugcgcuagcggacgguccaaggucaucaaaggcucucugccccucaucggggaagccgauugucugcaugagaaguacggaggccugaacaaaagcaagccuuacuauaccggcgaacacgcgaaagccauugggaauugcccgaucugggugaagacaccccucaagcuggcuaacggaaccaaauaccgcccucccgccaagcugcugaaagagagaggcuuuuucggggcuauugccggauuucucgagggcgggugggaaggcaugaucgccggauggcacggcuauacaucccauggggcucacggaguugcgguggccgcugaccuuaagagcacgcaggaggccauuaauaaaaucaccaagaaccuuaauucucuguccgaacucgaggucaagaaccugcaacggcugagcggcgccauggacgaacuccauaaugagauccuggagcuugaugaaaaaguggacgaucugcgcgcugacacaauuucuagccagaucgagcucgccguccugcuuuccaacgaagggauuaucaauucugaggaugaacaucugcucgcgcuggagagaaagcugaaaaagaugcucggaccuagcgcuguggagauuggcaacggguguuucgaaaccaaacacaagugcaaucagacaugccuggaccggaucgccgccggcaccuuuaacgcuggagaguucucccuucccacguuugauagccugaauaucaccgccgcuucucucaacgacgauggccuggacaaucacacaauucugcuuuacuauuccaccgccgcgagcucucucgccguuacacugaugcuggcuaucuucauuguguacauggucuccagagauaacgugagcuguuccaucugccucuga

SEQ ID NO: 210081 - RNA, 1755 nt, Artificial Sequence; identical to SEQ ID NO: 209844
  derived and/or modified sequence opt5 from hemagglutinin__InfluenzaB__AGX16478

SEQ ID NO: 210082 - RNA, 1755 nt, Artificial Sequence; identical to SEQ ID NO: 209591
  derived and/or modified sequence opt5 from hemagglutinin__InfluenzaB__AGX16489

SEQ ID NO: 210083 - RNA, 1758 nt, Artificial Sequence; identical to SEQ ID NO: 210003
  derived and/or modified sequence opt5 from hemagglutinin__InfluenzaB__AGX16500

SEQ ID NO: 210084 - RNA, 1758 nt, Artificial Sequence; identical to SEQ ID NO: 210003
  derived and/or modified sequence opt5 from hemagglutinin__InfluenzaB__AGX16511

SEQ ID NO: 210085 - RNA, 1758 nt, Artificial Sequence; identical to SEQ ID NO: 210003
  derived and/or modified sequence opt5 from hemagglutinin__InfluenzaB__AGX16522

SEQ ID NO: 210086 - RNA, 1758 nt, Artificial Sequence
  derived and/or modified sequence opt5 from hemagglutinin__InfluenzaB__AGX16533
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaaggagacacagauggccaaacuuuauggggauuccaagccccagaaauuuaccagcucugcuaacggaguuacaacccacuacgugucccaaaucggcggcuucccgaaccagacggaagacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaggcugacugucuccaugaaaaguauggcgggcugaauaaaucuaagcccuacuacacaggagagcacgccaaagcgauuggcaacugccccaucugggucaagaccccucugaaacucgccaaugggacaaaguaucgcccgcccgcuaagcugcuuaaagagagaggauuuuucggcgccaucgcuggguuucuggaaggcggaugggagggcaugauugccggguggcauggauacacgagccacggcgcccacgggguggcuguugcggccgaucucaaguccacccaggaagcuaucaacaaaauuacaaagaaucugaacagccuuucugagcuggaagugaaaaaucuccagcggcuguccggagccauggacgagcugcauaacgagauccucgaacuggaugagaaggucgacgaccuucgcgccgauaccauuagcucucaaaucgaacuggcugugcuccugagcaaugagggcaucauuaacuccgaagacgagcaccuucuggcccucgagagaaagcugaaaaagaugcuggggccuucugcggucgaaaucggcaauggauguuucgagacaaaacauaagugcaaccagaccugccucgaucggauugcugccggcacguuugacgccggggaguucagccugcccaccuuugauucccuuaauaucacagcugccagccugaacgacgauggacucgacaaucacaccauucugcuguauuacucuacagcugccuccagccuugcggugacccucaugaucgccauuuucguuguguauauggucucucgcgauaacguguccuguagcaucugccuguga

SEQ ID NO: 210087 - RNA, 1758 nt, Artificial Sequence
  derived and/or modified sequence opt5 from hemagglutinin__InfluenzaB__AGX16555
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgaggcccagauggcuaaacuuuauggggauuccaagccccagaaguuuacaagcucugccaacggaguuaccacacacuacgugucccaaaucggcggcuucccgaaucagaccgaagacgggggacugccucagagcggccgcaucguggucgauuauauggugcagaaaucugggaagacgggaacaauuaccuaccaaagaggcauccuccugccccagaaaguuuggugcgcuuccgggcggagcaaggugauuaaaggaucccuuccucugaucggcgaggccgacugucuccaugaaaaguauggcgggcugaacaagucuaaacccuacuacaccggagagcacgcgaaggccauuggcaauugccccaucugggucaaaacaccucugaagcucgcuaacgggaccaaauaucgcccgcccgccaagcugcuuaaggagagaggauuuuucggcgcuaucgccggguuucuggaaggcggaugggagggcaugauugccggguggcauggauacacaagccacggcgcucacgggguggcgguugccgcugaucucaaauccacgcaggaagccaucaauaagauuaccaaaaaccugaauagccuuucugagcuggaagugaagaaccuccagcggcuguccggagccauggacgagcugcauaaugagauccucgaacuggaugagaaagucgacgaccuucgcgcugauacaauuagcucucaaaucgaacuggccgugcuccugagcaacgagggcaucauuaauuccgaagacgagcaccuucuggcgcucgagagaaagcugaagaaaaugcuggggccuucugcugucgaaaucggcaacggauguuucgagaccaagcauaaaugcaaucagacaugccucgaucggauugccgccggcaccuuugacgcuggggaguucagccugcccacguuugauucccuuaacaucaccgccgcuagccugaaugacgauggacucgacaaccacacaauucugcuguauuacucuaccgccgcguccagccuugccgugacacucaugaucgcuauuuucguuguguauauggucucucgcgauaacguguccuguagcaucugccuguga

SEQ ID NO: 210088 - RNA, 1758 nt, Artificial Sequence
  derived and/or modified sequence opt5 from hemagglutinin__InfluenzaB__AGX16566
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagauccagauggccaaacuuuauggggauuccaagccccagaaguuuacaagcucugcuaacggaguuaccacacacuacgugucccaaaucggcggcuucccgaaucagaccgaagacgggggacugccucagagcggccgcauuguggucgauuauauggugcagaaaucugggaagacgggaacaaucaccuaccaaagaggcauucuccugccccagaaaguuuggugcgccuccgggcggagcaaggugaucaaaggaucccuuccucugauuggcgaggcugacugucuccaugaaaaguauggcgggcugaacaagucuaaacccuacuacaccggagagcacgccaaggcgaucggcaauugccccaucugggucaaaacaccucugaagcucgccaacgggaccaaauaucgcccgcccgcuaagcugcuuaaggagagaggauuuuucggcgccauugcuggguuucuggaaggcggaugggagggcaugaucgccggguggcauggauacacaagccacggcgcccacgggguggcuguugcggccgaucucaaauccacgcaggaagcuauuaauaagaucaccaaaaaccugaauagccuuucugagcuggaagugaagaaccuccagcggcuguccggagccauggacgagcugcauaaugagauucucgaacuggaugagaaagucgacgaccuucgcgccgauacaaucagcucucaaaucgaacuggcugugcuccugagcaacgagggcauuaucaauuccgaagacgagcaccuucuggcccucgagagaaagcugaagaaaaugcuggggccuucugcggucgaaauuggcaacggauguuucgagaccaagcauaaaugcaaucagacaugccucgaucggaucgcugccggcaccuuugacgccggggaguucagccugcccacguuugauucccuuaacauuaccgcugccagccugaaugacgauggacucgacaaccacacaauccugcuguauuacucuaccgcugccuccagccuugcggugacacucaugauugccaucuucguuguguauauggucucucgcgauaacguguccuguagcaucugccuguga

SEQ ID NO: 210089 - RNA, 1758 nt, Artificial Sequence; identical to SEQ ID NO: 210003
  derived and/or modified sequence opt5 from hemagglutinin__InfluenzaB__AGX16577

SEQ ID NO: 210090 - RNA, 1758 nt, Artificial Sequence
  derived and/or modified sequence opt5 from hemagglutinin__InfluenzaB__AGX16588
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagauccagauggccaaacuuuauggggauuccaagccccagaaguuuacaagcucugcuaacggaguuaccacacacuacgugucccaaaucggcggcuucccgaaucagaccgaagacgggggacugccucagagcggccgcauuguggucgauuauauggugcagaaaucugggaagacgggaacaaucaccuaccaaagaggcauucuccugccccagaaaguuuggugcgccuccgggcggagcaaggugaucaaaggaucccuuccucugauuggcgaggcugacugucuccaugaaaaguauggcgggcugaacaagucuaaacccuacuacaccggagagcacgccaaggcgaucggcaauugccccaucugggucaaaacaccucugaagcucgccaacgggaccaaauaucgcccgcccgcuaagcugcuuaaggagagaggauuuuucggcgccauugcuggguuucuggaaggcggaugggagggcaugaucgccggguggcauggauacacaagccacggcgcccacgggguggcuguugcggccgaucucaaauccacgcaggaagcuauuaauaagaucaccaaaaaccugaauagccuuucugagcuggaagugaagaaccuccagcggcuguccggagccauggacgagcugcauaaugagauucucgaacuggaugagaaagucgacgaccuucgcgccgauacaaucagcucucaaaucgaacuggcugugcuccugagcaacgagggcauuaucaauuccgaagacgagcaccuucuggcccucgagagaaagcugaagaaaaugcuggggccuucugcgauugaaaucggcaacggauguuucgagaccaagcauaaaugcaaucagacaugccucgaucggauugcugccggcaccuuugacgccggggaguucagccugcccacguuugauucccuuaacaucaccgcugccagccugaaugacgauggacucgacaaccacacaauucugcuguauuacucuaccgcugccuccagccuugcggucacacucaugaucgccaucuucgugguuuauauggugucucgcgauaacgucuccuguagcauuugccuguga

SEQ ID NO: 210091 - RNA, 1758 nt, Artificial Sequence; identical to SEQ ID NO: 210003
  derived and/or modified sequence opt5 from hemagglutinin__InfluenzaB__AGX16599

SEQ ID NO: 210092 - RNA, 1758 nt, Artificial Sequence; identical to SEQ ID NO: 210086
  derived and/or modified sequence opt5 from hemagglutinin__InfluenzaB__AGX16610

SEQ ID NO: 210093 - RNA, 1758 nt, Artificial Sequence; identical to SEQ ID NO: 210003
  derived and/or modified sequence opt5 from hemagglutinin__InfluenzaB__AGX16621

SEQ ID NO: 210094 - RNA, 1758 nt, Artificial Sequence
  derived and/or modified sequence opt5 from hemagglutinin__InfluenzaB__AGX16654
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgauuaauagccugaccaucgaggugccuuacauuuguacagaaggagaggaucagaucacggucuggggcuuccacucugacaacgagacccagauggccaaacuuuauggggauuccaagccccagaaguuuacaagcucugcuaacggaguuaccacacacuacgugucccaaaucggcggcuucccgaaucagaccgaagacgggggacugccucagagcggccgcauuguggucgauuauauggugcagaaaucugggaagacgggaacaaucaccuaccaaagaggcauucuccugccccagaaaguuuggugcgccuccgggcggagcaaggugaucaaaggaucccuuccucugauuggcgaggcugacugucuccaugaaaaguauggcgggcugaacaagucuaaacccuacuacaccggagagcacgccaaggcgaucggcaauugccccaucugggucaaaacaccucugaagcucgccaacgggaccaaauaucgcccgcccgcuaagcugcuuaaggagagaggauuuuucggcgccauugcuggguuucuggaaggcggaugggagggcaugaucgccggguggcauggauacacaagccacggcgcccacgggguggcuguugcggccgaucucaaauccacgcaggaagcuauuaauaagaucaccaaaaaccugaauagccuuucugagcuggaagugaagaaccuccagcggcuguccggagccauggacgagcugcauaaugagauucucgaacuggaugagaaagucgacgaccuucgcgccgauacaaucagcucucaaaucgaacuggcugugcuccugagcaacgagggcauuaucaauuccgaagacgagcaccuucuggcccucgagagaaagcugaagaaaaugcuggggccuucugcgauugaaaucggcaacggauguuucgagaccaagcauaaaugcaaucagacaugccucgaucggauugcugccggcaccuuugacgccggggaguucagccugcccacguuugauucccuuaacaucaccgcugccagccugaaugacgauggacucgacaaccacacaauucugcuguauuacucuaccgcugccuccagccuugcggucacacucaugaucgccaucuucgugguuuauauggugucucgcgauaacgucuccuguagcauuugccuguga

SEQ ID NO: 210095 - RNA, 1758 nt, Artificial Sequence; identical to SEQ ID NO: 210003
  derived and/or modified sequence opt5 from hemagglutinin__InfluenzaB__AGX16665

SEQ ID NO: 210096 - RNA, 1758 nt, Artificial Sequence; identical to SEQ ID NO: 210003
  derived and/or modified sequence opt5 from hemagglutinin__InfluenzaB__AGX16676

SEQ ID NO: 210097 - RNA, 1758 nt, Artificial Sequence; identical to SEQ ID NO: 210003
  derived and/or modified sequence opt5 from hemagglutinin__InfluenzaB__AGX16687

SEQ ID NO: 210098 - RNA, 1758 nt, Artificial Sequence; identical to SEQ ID NO: 210003
  derived and/or modified sequence opt5 from hemagglutinin__InfluenzaB__AGX16698

SEQ ID NO: 210099 - RNA, 1758 nt, Artificial Sequence
  derived and/or modified sequence opt5 from hemagglutinin__InfluenzaB__AGX16709
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccgaaaauauucccucugccaaagucagcauccugcacgaggugagaccuguuacauccggcuguuuucccaucaugcaugaucggaccaagauucgccaacucccuaaccugcugagaggguacgaacacauccggcucucuacgcauaaugugauuaacgccgagaaagcuccgggaggccccuauaagaucggcacaagcggguccugcccuaaugucaccaacggaaauggcuucuuugccacaauggcuugggccgugcccaaaaacgacaauaacaagaccgcgaccaauagccugacaauugaagugccuuacaucuguacggagggggaggaucagauuaccgucuggggauuccacucugacaacgaaacacagauggccaaacuuuauggcgauuccaaaccccagaaguuuaccagcucugcuaacgggguuacaacccacuacgugucccaaaucggaggcuucccgaaucagacggaggacggcgggcugccucagagcggacgcaucguggucgauuauauggugcagaaaucuggcaagacagggaccauuaccuaccaaagaggaauccuccugccccagaaaguuuggugcgccuccggccggagcaaggugauuaaagggucccuuccucugaucggagaagcugacugucuccaugagaaguauggcggccugaacaagucuaaacccuacuacacaggggagcacgccaaggcgauuggaaauugccccaucugggucaaaaccccucugaagcucgccaacggcacaaaauaucgcccgcccgcuaagcugcuuaaggaaagaggguuuuucggagccaucgcuggcuuucuggaagggggcugggagggaaugauugccggcuggcauggguacacgagccacggagcccacggcguggcuguugcggccgaucucaaauccacccaggaggcuaucaauaagauuacaaagaaccugaauagccuuucugaacuggaggugaagaaccuccagcggcuguccggggccauggacgagcugcauaaugaaauccucgagcuggaugaaaaagucgacgaccuucgcgccgauaccauuagcucucaaaucgagcuggcugugcuccugagcaacgaaggaaucauuaauuccgaggacgagcaccuucuggcccucgaaagaaagcugaagaaaaugcugggcccuucugcggucgagaucgggaacggcuguuucgaaacaaagcauaaaugcaaucagaccugccucgaucggauugcugccggaacguuugacgccggcgaguucagccugcccaccuuugauucccuuaacaucacagcugccagccugaaugacgaugggcucgacaaccacaccauucugcuguauuacucuacagcugccuccagccuugcggugacccucaugaucgccauuuucguuguguauauggucucucgcgauaacguguccuguagcaucugccuguga

SEQ ID NO: 210100 - RNA, 1758 nt, Artificial Sequence; identical to SEQ ID NO: 210003
  derived and/or modified sequence opt5 from hemagglutinin__InfluenzaB__AGX16720

SEQ ID NO: 210101 - RNA, 1758 nt, Artificial Sequence; identical to SEQ ID NO: 210003
  derived and/or modified sequence opt5 from hemagglutinin__InfluenzaB__AGX16731

SEQ ID NO: 210102 - RNA, 1758 nt, Artificial Sequence
  derived and/or modified sequence opt5 from hemagglutinin__InfluenzaB__AGX16742
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcaucauccacgaagugagaccuguuacauccggguguuuucccauuaugcaugaucggaccaagauccgccaacugccuaaccuccugagaggauacgagcacauucggcugucuacgcauaaugugaucaacgccgaaaaagcuccgggcggccccuauaagauugggacaagcggauccugcccuaaugucaccaacggcaauggguucuuugccacaauggcuugggccgugcccaaaaacgacaauaacaagaccgcgaccaauagccucacaaucgaggugccuuacauuuguacggaaggagaggaucagaucaccgucuggggcuuccacucugacaacgagacacagauggccaagcuguauggggauuccaaaccccagaaguuuaccagcucugcuaacggaguuacaacccacuacgugucccaaaucggcggcuucccgaaucagacggaagacgggggacuuccucagagcggccgcauuguggucgauuauauggugcagaaaucugggaagacaggaaccaucaccuaccaaagaggcauucugcucccccagaaaguuuggugcgccuccgggcggagcaaggugaucaaaggaucccugccucuuauuggcgaggcugacugucugcaugaaaaguauggcgggcucaacaagucuaaacccuacuacacaggagagcacgccaaggcgaucggcaauugccccaucugggucaaaaccccucugaagcuggccaacgggacaaaauaucgcccgcccgcuaagcuccugaaggagagaggauuuuucggcgccauugcuggguuucuugaaggcggaugggagggcaugaucgccggguggcauggauacacgagccacggcgcccacgggguggcuguugcggccgaucugaaauccacccaggaagcuauuaauaagaucaccaaaaaccucaauagccugucugagcuugaagugaagaaccugcagcggcucuccggagccauggacgagcugcauaaugagauucuggaacucgaugagaaagucgacgaccugcgcgccgauacaaucagcucucaaaucgaacuugcugugcugcucagcaacgagggcauuaucaauuccgaagacgagcaucugcuugcccuggagagaaagcucaagaaaaugcuggggccuucugcggucgaaauuggcaacggauguuucgagacaaagcacaaaugcaaucagaccugccuggaucggaucgcugccggcacguuugacgccggggaguucagccuccccaccuuugauucccugaacauuacagcugccagccuuaaugacgauggacuggacaaccacaccauccuccuguauuacucuacagcugccuccagccuggcggugacccuuaugauugccaucuucguuguguauauggucucucgcgauaacguguccuguagcaucugccucuga

SEQ ID NO: 210103 - RNA, 1758 nt, Artificial Sequence; identical to SEQ ID NO: 210003
  derived and/or modified sequence opt5 from hemagglutinin__InfluenzaB__AGX16753

SEQ ID NO: 210104 - RNA, 1758 nt, Artificial Sequence; identical to SEQ ID NO: 210003
  derived and/or modified sequence opt5 from hemagglutinin__InfluenzaB__AGX16764

SEQ ID NO: 210105 - RNA, 1758 nt, Artificial Sequence; identical to SEQ ID NO: 210003
  derived and/or modified sequence opt5 from hemagglutinin__InfluenzaB__AGX16775

SEQ ID NO: 210106 - RNA, 1758 nt, Artificial Sequence
  derived and/or modified sequence opt5 from hemagglutinin__InfluenzaB__AGX16797
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauaugcccucugccaaagucagcauucugcacgaagugagaccuguuacauccggguguuuucccaucaugcaugaucggaccaagauccgccaacucccuaaccugcugagaggauacgagcacauucggcucucuacgcauaaugugaucaacgccgaaaaagcuccgggcggccccuauaagauugggacaagcggauccugcccuaaugucaccaacggcaauggguucuuugccacaauggcuugggccgugcccaaaaacgacaauaacaagaccgcgaccaauagccugacaaucgaggugccuuacauuuguacggaaggagaggaucagaucaccgucuggggcuuccacucugacaacgagacacagauggccaaacuuuauggggauuccaaaccccagaaguuuaccagcucugcuaacggaguuacaacccacuacgugucccaaauuggcggcuucccgaaucagacggaagacgggggacugccucagagcggccgcaucguggucgauuauauggugcagaaaucugggaagacaggaaccaucaccuaccaaagaggcauucuccugccccagaaaguuuggugcgccuccgggcggagcaaggugaucaaaggaucccuuccucugauuggcgaggcugacugucuccaugaaaaguauggcgggcugaacaagucuaaacccuacuacacaggagagcacgccaaggcgaucggcaauugccccauuugggucaaaaccccucugaagcucgccaacgggacaaaauaucgcccgcccgcuaagcugcuuaaggagagaggauuuuucggcgccaucgcuggguuucuggaaggcggaugggagggcaugaucgccggguggcauggauacacgagccacggcgcccacgggguggcuguugcggccgaucucaaauccacccaggaagcuauuaauaagaucacaaagaaccugaauagccuuucugagcuggaagugaagaaccuccagcggcuguccggagccauggacgagcugcauaaugagauucucgaacuggaugagaaagucgacgaccuucgcgccgauaccaucagcucucaaauugaacuggcugugcuccugagcaacgagggcaucaucaauuccgaagacgagcaccuucuggcccucgagagaaagcugaagaaaaugcuggggccuucugcggucgaaauuggcaacggauguuucgagacaaagcauaaaugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggugacccucaugauugccaucuucguuguguauauggucucucgcgauaacguguccuguagcauuugccuguga

SEQ ID NO: 210107 - RNA, 1758 nt, Artificial Sequence; identical to SEQ ID NO: 210003
  derived and/or modified sequence opt5 from hemagglutinin__InfluenzaB__AGX16808

SEQ ID NO: 210108 - RNA, 1758 nt, Artificial Sequence
  derived and/or modified sequence opt5 from hemagglutinin__InfluenzaB__AGX16819
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacuccgagacacagauggccaaacuuuauggggauagcaaaccccagaaguuuaccucuuccgcuaacggaguuacaacccacuacgugagccaaaucggcggcuucccgaaccagacggaagacgggggacugccucagucuggccgcaucguggucgauuauauggugcagaaauccgggaagacaggaaccauuaccuaccaaagaggcauccuccugccccagaaaguuuggugcgccagcgggcgguccaaggugauuaaaggaucucuuccucugaucggcgaggcugacugucuccaugaaaaguauggcgggcugaauaagagcaaacccuacuacacaggagagcacgccaaggcgauuggcaacugccccaucugggucaaaaccccucugaagcucgccaaugggacaaaauaucgcccgcccgcuaagcugcuuaaggagagaggauuuuucggcgccaucgcuggguuucuggaaggcggaugggagggcaugauugccggguggcauggauacacgucccacggcgcccacgggguggcuguugcggccgaucucaaaagcacccaggaagcuaucaacaagauuacaaagaaucugaacucucuuuccgagcuggaagugaagaaucuccagcggcugagcggagccauggacgagcugcauaacgagauccucgaacuggaugagaaagucgacgaccuucgcgccgauaccauuucuagccaaaucgaacuggcugugcuccuguccaaugagggcaucauuaacucugaagacgagcaccuucuggcccucgagagaaagcugaagaaaaugcuggggccuagcgcggucgaaaucggcaauggauguuucgagacaaagcauaaaugcaaccagaccugccucgaucggauugcugccggcacguuugacgccggggaguucucccugcccaccuuugauagccuuaauaucacagcugccucucugaacgacgauggacucgacaaucacaccauucugcuguauuacuccacagcugccagcucucuugcggugacccucaugaucgccauuuucaucguuuauauggugucccgcgauaacgucagcuguuccaucugccuguga

SEQ ID NO: 210109 - RNA, 1758 nt, Artificial Sequence; identical to SEQ ID NO: 210003
  derived and/or modified sequence opt5 from hemagglutinin__InfluenzaB__AGX16830

SEQ ID NO: 210110 - RNA, 1758 nt, Artificial Sequence
  derived and/or modified sequence opt5 from hemagglutinin__InfluenzaB__AGX16841
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaaugacaacccacuacguuucccaaaucggcggcuucccgaaucagacggaagacgggggacugccucagagcggccgcaucgugguggauuauaugguccagaaaucugggaagacaggaaccauuaccuaccaaagaggcauccuccugccccagaaaguguggugcgccuccgggcggagcaagguuauuaaaggaucccuuccucugaucggcgaggcugacugucuccaugaaaaguauggcgggcugaacaagucuaaacccuacuacacaggagagcacgccaaggcgauuggcaauugccccaucugggugaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacggggucgcuguggcggccgaucucaaauccacccaggaagcuaucaauaagauuacaaagaaccugaauagccuuucugagcuggaaguuaagaaccuccagcggcuguccggagccauggacgagcugcauaaugagauccucgaacuggaugagaaaguggacgaccuucgcgccgauaccauuagcucucaaaucgaacuggcuguccuccugagcaacgagggcaucauuaauuccgaagacgagcaccuucuggcccucgagagaaagcugaagaaaaugcuggggccuucugcgguggaaaucggcaacggauguuucgagacaaagcauaaaugcaaucagaccugccucgaucggauugcugccggcacguuugacgccggggaguucagccugcccaccuuugauucccuuaacaucacagcugccagccugaauggagacggccucgauaaccacaccauucugcuguauuacucuacagcugccuccagccuugcggucacccucaugaucgccauuuucgugguuuauauggugucucgcgacaacgucuccuguagcaucugccuguga

SEQ ID NO: 210111 - RNA, 1758 nt, Artificial Sequence
  derived and/or modified sequence opt5 from hemagglutinin__InfluenzaB__AGX16852
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcgccuccgggcggagcaaggugauuaaaggaucccuuccucugaucggcgaggcugacugucuccaugaaaaguauggcgggcugaacaagucuaaacccuacuacacaggagagcacgccaaggcgauuggcaauugccccaucugggucaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacgggguggcuguugcggccgaucucaaauccacccaggaagcuaucaauaagauuacaaagaaccugaauagccuuucugagcuggaagugaagaaccuccagcggaucuccggagccauggacgagcugcauaaugagauucuggaacucgaugagaaagucgacgaccugcgcgccgauaccaucagcucucaaaucgaacuugcugugcugcucagcaacgagggcauuaucaauuccgaagacgagcaucugcuugcccuggagagaaagcucaagaaaaugcuggggccuucugcggucgaaauuggcaacggauguuucgagacaaagcacaaaugcaaucagaccugccuggaucggaucgcugccggcacguuugacgccggggaguucagccuccccaccuuugauucccugaacauuacagcugccagccuuaaugacgauggacuggacaaccacaccauccuccuguauuacucuacagcugccuccagccuggcggugacccuuaugauugccaucuucguuguguauauggucucucgcgauaacguguccuguagcaucugccucuga

SEQ ID NO: 210112 - RNA, 1758 nt, Artificial Sequence; identical to SEQ ID NO: 210003
  derived and/or modified sequence opt5 from hemagglutinin__InfluenzaB__AGX16863

SEQ ID NO: 210113 - RNA, 1758 nt, Artificial Sequence; identical to SEQ ID NO: 210003
  derived and/or modified sequence opt5 from hemagglutinin__InfluenzaB__AGX16874

SEQ ID NO: 210114 - RNA, 1758 nt, Artificial Sequence
  derived and/or modified sequence opt5 from hemagglutinin__InfluenzaB__AGX16885
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcgccuccgggcggagcaaggugauuaaaggaucccuuccucugaucggcgaggcugacugucuccaugaaaaguauggcgggcugaacaagucuaaacccuacuacacaggagagcacgccaaggcgauuggcaauugccccaucugggucaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacgggguggcuguugcggccgaucucaaauccacccaggaagcuaucaauaagauuacaaagaaccugaauagccuuucugagcuggaagugaagaaccuccagcggcuguccggagccauggacgagcugcauaaugagauccucgaacuggaugagaaagucgacgaccuucgcgccgauaccauuagcucucaaaucgaacuggcugugcuccugagcaacgagggcaucauuaauuccgaagacgagcaccuucuggcccucgagagaaagcugaagaaaaugcuggggccuucugcgaucgaaauuggcaacggauguuucgagacaaagcauaaaugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauugccaucuucgugguuuauauggugucucgcgauaacgucuccuguagcaucugccuguga

SEQ ID NO: 210115 - RNA, 1758 nt, Artificial Sequence; identical to SEQ ID NO: 210114
  derived and/or modified sequence opt5 from hemagglutinin__InfluenzaB__AGX16896

SEQ ID NO: 210116 - RNA, 1758 nt, Artificial Sequence; identical to SEQ ID NO: 210003
  derived and/or modified sequence opt5 from hemagglutinin__InfluenzaB__AGX16907

SEQ ID NO: 210117 - RNA, 1758 nt, Artificial Sequence; identical to SEQ ID NO: 210088
  derived and/or modified sequence opt5 from hemagglutinin__InfluenzaB__AGX16918

SEQ ID NO: 210118 - RNA, 1758 nt, Artificial Sequence; identical to SEQ ID NO: 210003
  derived and/or modified sequence opt5 from hemagglutinin__InfluenzaB__AGX16940

SEQ ID NO: 210119 - RNA, 1758 nt, Artificial Sequence; identical to SEQ ID NO: 210114
  derived and/or modified sequence opt5 from hemagglutinin__InfluenzaB__AGX16951

SEQ ID NO: 210120 - RNA, 1758 nt, Artificial Sequence
  derived and/or modified sequence opt5 from hemagglutinin__InfluenzaB__AGX16962
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccgaaucccauuucgcgaaucuuaagggcacgaaaacccgggggaagcugugucccaaaugccucaacuguacagaucuggacguggcucuuggacgcccuaagugcaccggcaauauucccucugccaaggucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagaaggaggacgggggacugccucagagcggccgcaucguggucgauuauauggugcagaaaucugggaacacgggaacaauuaccuaccaaagaggcauccuccugccccagaagguuuggugcgccuccgggcggagcaaagugauuaagggaucccuuccucugaucggcgaagcugacugucuccaugagaaauauggcgggcugaauaagucuaagcccuacuacaccggagagcacgccaaagcgauuggcaacugccccaucugggucaagacaccucugaaacucgccaaugggaccaaguaucgcccgcccgcuaaacugcuuaaggaaagaggauuuuucggcgccaucgcuggguuucuggagggcggaugggaaggcaugauugccggguggcauggauacacaagccacggcgcccacgggguggcuguugcggccgaucucaaguccacgcaggaggcuaucaacaaaauuaccaagaaucugaacagccuuucugaacuggaggugaaaaaucuccagcggcuguccggagccauggacgagcugcauaacgaaauccucgagcuggaugaaaaggucgacgaccuucgcgccgauacaauuagcucucaaaucgagcuggcugugcuccugagcaaugaaggcaucauuaacuccgaggacgagcaccuucuggcccucgaaagaaaacugaagaagaugcuggggccuucugcggucgagaucggcaauggauguuucgaaaccaaacauaagugcaaccagacaugccucgaucggauugcugccggcaccuuugacgccggggaguucagccugcccacguuugauucccuuaauaucaccgcugccagccugaacgacgauggacucgacaaccacacaauucugcuguauuacucuaccgcugccuccagccuugcggugacacucaugaucgccauuuucguuguguauauggucucucgcgauaauguguccuguagcaucugccuguga

SEQ ID NO: 210121 - RNA, 1758 nt, Artificial Sequence; identical to SEQ ID NO: 210003
  derived and/or modified sequence opt5 from hemagglutinin__InfluenzaB__AGX16973

SEQ ID NO: 210122 - RNA, 1758 nt, Artificial Sequence
  derived and/or modified sequence opt5 from hemagglutinin__InfluenzaB__AGX16995
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaguggaggucccuuacauuuguacggaaggagaggaucagaucaccguuuggggcuuccacucugacaacgagauucagauggccaaacuuuauggggauuccaagccccagaaguuuacaagcucugcuaacggagugaccacacacuacgugucccaaaucggcggcuucccgaaucagaccgaagacgggggacugccucagagcggccgcaucgucguggauuauaugguucagaaaucugggaagacgggaacaauuaccuaccaaagaggcauccuccugccccagaaaguguggugcgccuccgggcggagcaaggucauuaaaggaucccuuccucugaucggcgaggcugacugucuccaugaaaaguauggcgggcugaacaagucuaaacccuacuacaccggagagcacgccaaggcgauuggcaauugccccaucugggugaaaacaccucugaagcucgccaacgggaccaaauaucgcccgcccgcuaagcugcuuaaggagagaggauuuuucggcgccaucgcuggguuucuggaaggcggaugggagggcaugauugccggguggcauggauacacaagccacggcgcccacgggguugcuguggcggccgaucucaaauccacgcaggaagcuaucaauaagauuaccaaaaaccugaauagccuuucugagcuggaagucaagaaccuccagcggcuguccggagccauggacgagcugcauaaugagauccucgaacuggaugagaaaguggacgaccuucgcgccgauacaauuagcucucaaaucgaacuggcuguccuccugagcaacgagggcaucauuaauuccgaagacgagcaccuucuggcccucgagagaaagcugaagaaaaugcuggggccuucugcgguggaaaucggcaacggauguuucgagaccaagcauaaaugcaaucagacaugccucgaucggauugcugccggcaccuuugacgccggggaguucagccugcccacguuugauucccuuaacaucaccgcugccagccugaaugacgauggacucgacaaccacacaauucugcuguauuacucuaccgcugccuccagccuugcgguuacacucaugaucgccauuuucguggucuauauggugucucgcgauaacguuuccuguagcaucugccuguga

SEQ ID NO: 210123 - RNA, 1758 nt, Artificial Sequence
  derived and/or modified sequence opt5 from hemagglutinin__InfluenzaB__AGX17006
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagaaccagauggccaaacuuuauggggauuccaagccccagaaguuuacaagcucugcuaauggaguuaccacacacuacgugucccaaaucggcggcuucccgaaccagaccgaagacgggggacugccucagagcggccgcaucguggucgauuauauggugcagaaaucugggaagacgggaacaauuaccuaccaaagaggcauccuccugccccagaaaguuuggugcgccuccgggcggagcaaggugauuaaaggaucccuuccucugaucggcgaggcugacugucuccaugaaaaguauggcgggcugaauaagucuaaacccuacuacaccggagagcacgccaaggcgauuggcaacugccccaucugggucaaaacaccucugaagcucgccaaugggaccaaauaucgcccgcccgcuaagcugcuuaaggagagaggauuuuucggcgccaucgcuggguuucuggaaggcggaugggagggcaugauugccggguggcauggauacacaagccacggcgcccacgggguggcuguugcggccgaucucaaauccacgcaggaagcuaucaacaagauuaccaaaaaucugaacagccuuucugagcuggaagugaagaaucuccagcggcuguccggagccauggacgagcugcauaacgagauccucgaacuggaugagaaagucgacgaccuucgcgccgauacaauuagcucucaaaucgaacuggcugugcuccugagcaaugagggcaucauuaacuccgaagacgagcaccuucuggcccucgagagaaagcugaagaaaaugcuggggccuucugcggucgaaaucggcaauggauguuucgagaccaagcauaaaugcaaccagacaugccucgaucggauugcugccggcaccuuugacgccggggaguucagccugcccacguuugauucccuuaauaucaccgcugccagccugaacgacgauggacucgacaaccacacaauucugcuguauuacucuaccgcugccuccagccuugcggugacacucaugaucgccauuuucguuguguauauggucucucgcgauaauguguccuguagcaucugccuguga

SEQ ID NO: 210124 - RNA, 1758 nt, Artificial Sequence; identical to SEQ ID NO: 210003
  derived and/or modified sequence opt5 from hemagglutinin__InfluenzaB__AGX17017

SEQ ID NO: 210125 - RNA, 1758 nt, Artificial Sequence; identical to SEQ ID NO: 210003
  derived and/or modified sequence opt5 from hemagglutinin__InfluenzaB__AGX17028

SEQ ID NO: 210126 - RNA, 1758 nt, Artificial Sequence
  derived and/or modified sequence opt5 from hemagglutinin__InfluenzaB__AGX17039
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccgaaucccauuucgcgaaucuuaagggcacgaaaacccgggggaagcugugucccaaaugccucaacuguacagaucuggacguggcucuuggacgcccuaagugcaccggcaauauucccucugccaaggucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaauuuaccagcucugcuaacggaguuacaacccacuacgugucccaaaucggcggcuucccgaaucagacggaggacgggggacugccucagagcggccgcaucguggucgauuauauggugcagaagucugggaacacaggaaccauuaccuaccaaagaggcauccuccugccccagaaaguuuggugcgccuccgggcggagcaaggugauuaaaggaucccuuccucugaucggcgaagcugacugucuccaugagaaguauggcgggcugaauaaaucuaagcccuacuacacaggagagcacgccaaggcgauuggcaacugccccaucugggucaaaaccccucugaagcucgccaaugggacaaaauaucgcccgcccgcuaagcugcuuaaagaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaacaagauuacaaagaaucugaacagccuuucugaacuggaggugaagaaucuccagcggcuguccggagccauggacgagcugcauaacgaaauccucgagcuggaugaaaaagucgacgaccuucgcgccgauaccauuagcucucaaaucgagcuggcugugcuccugagcaaugaaggcaucauuaacuccgaggacgagcaccuucuggcccucgaaagaaagcugaaaaagaugcuggggccuucugcggucgagaucggcaauggauguuucgaaacaaagcauaaaugcaaccagaccugccucgaucggauugcugccggcacguuugacgccggggaguucagccugcccaccuuugauucccuuaauaucacagcugccagccugaacgacgauggacucgacaaccacaccauuaugcuguauuacucuacagcugccuccagccuggcggugacccuuaugaucgccauuuucguuguguauauggucucucgcgauaauguguccuguagcaucugccucuga

SEQ ID NO: 210127 - RNA, 1758 nt, Artificial Sequence; identical to SEQ ID NO: 210003
  derived and/or modified sequence opt5 from hemagglutinin__InfluenzaB__AGX17050

SEQ ID NO: 210128 - RNA, 1758 nt, Artificial Sequence
  derived and/or modified sequence opt5 from hemagglutinin__InfluenzaB__AGX17061
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcggauccgccucucuaaucacaacgugauuaaugccgaaaaagcuccgggcggccccuauaagaucgggacgagcggauccugcccuaacgucacaaauggcaacggguucuuugccaccauggcuugggccgugcccaaaaaugagaacaauaagacagcgaccaacagccugaccauugaagugccuuacaucuguacagagggagaggaccagauuacggucuggggcuuccauucugauaacgaaacccagauggccaaacuuuauggggacuccaagccccagaaguuuacaagcucugcuaauggaguuaccacacacuacgugucccaaaucggcggcuucccgaaccagaccgaggaugggggacugccucagagcggcagaaucguggucgacuauauggugcagaaaucugggaagacgggaacaauuaccuaccaacggggcauccuccugccccagaaaguuuggugcgccuccgggcgcagcaaggugauuaaaggaucccuuccucugaucggcgaagcugauugucuccacgagaaguauggcgggcugaauaagucuaaacccuacuacaccggagagcaugccaaggcgauuggcaacugccccaucugggucaaaacaccucugaagcucgccaaugggaccaaauauagaccgcccgcuaagcugcuuaaggaacggggauuuuucggcgccaucgcuggguuucuggagggcggaugggaaggcaugauugccggguggcacggauacacaagccauggcgcccacgggguggcuguugcggccgaccucaaauccacgcaggaggcuaucaacaagauuaccaaaaaucugaacagccuuucugaacuggaggugaagaaucuccagcgccuguccggagccauggaugagcugcacaacgaaauccucgagcuggacgaaaaagucgaugaccuuagagccgacacaauuagcucucaaaucgagcuggcugugcuccugagcaaugaaggcaucauuaacuccgaggaugagcaucuucuggcccucgaacggaagcugaagaaaaugcuggggccuucugcggucgagaucggcaauggauguuucgaaaccaagcacaaaugcaaccagacaugccucgaccgcauugcugccggcaccuuuaaugccggggaguucagccugcccacguuugauucccuuaacaucaccgcugccagccugaacgacgauggacucgacaaucauacaauucugcuguauuacucuaccgcugccuccagccuugcggugacacucaugaucgccauuuucguuguguauauggucucuagagauaacguguccuguagcaucugccuguga

SEQ ID NO: 210129 - RNA, 1758 nt, Artificial Sequence
  derived and/or modified sequence opt5 from hemagglutinin__InfluenzaB__AGX17072
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccgaaucccauuucgcgaaucuuaagggcacgaaaacccgggggaagcugugucccaaaugccucaacuguacagaucuggacguggcucuuggacgcccuaagugcaccggcaauauucccucugccaaggucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaacacagauggccaaacuuuauggggauuccaagccccagaaauuuaccagcucugcuaacggaguuacaacccacuacgugucccaaaucggcggcuucccgaaucagacggaggacgggggacugccucagagcggccgcaucguggucgauuauauggugcagaagucugggaacacaggaaccauuaccuaccaaagaggcauccuccugccccagaaaguuuggugcgccuccgggcggagcaaggugauuaaaggaucccuuccucugaucggcgaagcugacugucuccaugagaaguauggcgggcugaauaaaucuaagcccuacuacacaggagagcacgccaaggcgauuggcaacugccccaucugggucaaaaccccucugaagcucgccaaugggacaaaauaucgcccgcccgcuaagcugcuuaaagaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaacaagauuacaaagaaucugaacagccuuucugaacuggaggugaagaaucuccagcggcuguccggagccauggacgagcugcauaacgaaauccucgagcuggaugaaaaagucgacgaccuucgcgccgauaccauuagcucucaaaucgagcuggcugugcuccugagcaaugaaggcaucauuaacuccgaggacgagcaccuucuggcccucgaaagaaagcugaaaaagaugcuggggccuucugcggucgagaucggcaauggauguuucgaaacaaagcauaaaugcaaccagaccugccucgaucggauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucucgcgauaauguguccuguagcaucugccuguga

SEQ ID NO: 210130 - RNA, 1758 nt, Artificial Sequence; identical to SEQ ID NO: 210114
  derived and/or modified sequence opt5 from hemagglutinin__InfluenzaB__AGX17083

SEQ ID NO: 210131 - RNA, 1758 nt, Artificial Sequence
  derived and/or modified sequence opt5 from hemagglutinin__InfluenzaB__AGX17094
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacuccgagacacagauggccaaacuuuauggggauagcaaaccccagaaguuuaccucuuccgcuaacggaguuacaacccacuacgugagccaaaucggcggcuucccgaaccagacggaagacgggggacugccucagucuggccgcaucguggucgauuauauggugcagaaauccgggaagacaggaaccauuaccuaccaaagaggcauccuccugccccagaaaguuuggugcgccagcgggcgguccaaggugauuaaaggaucucuuccucugaucggcgaggcugacugucuccaugaaaaguauggcgggcugaauaagagcaaacccuacuacacaggagagcacgccaaggcgauuggcaacugccccaucugggucaaaaccccucugaagcucgccaaugggacaaaauaucgcccgcccgcuaagcugcuuaaggagagaggauuuuucggcgccaucgcuggguuucuggaaggcggaugggagggcaugauugccggguggcauggauacacgucccacggcgcccacgggguggcuguugcggccgaucucaaaagcacccaggaagcuaucaacaagauuacaaagaaucugaacucucuuuccgagcuggaagugaagaaucuccagcggcugagcggagccauggacgagcugcauaacgagauccucgaacuggaugagaaagucgacgaccuucgcgccgauaccauuucuagccaaaucgaacuggcugugcuccuguccaaugagggcaucauuaacucugaagacgagcaccuucuggcccucgagagaaagcugaagaaaaugcuggggccuagcgcggucgaaaucggcaauggauguuucgagacaaagcauaaaugcaaccagaccugccucgaucggauugcugccggcacguuugacgccggggaguucucccugcccaccuuugauagccuuaauaucacagcugccucucugaacgacgauggacucgacaaucacaccauucugcuguauuacuccacagcugccagcucucuugcggugacccucaugaucgccauuuucguuguguauauggucucccgcgauaacgugagcuguuccaucugccuguga

SEQ ID NO: 210132 - RNA, 1758 nt, Artificial Sequence
  derived and/or modified sequence opt5 from hemagglutinin__InfluenzaB__AGX17105
augaaggccaucauugugcugcucauggucguuaccagcaacgcugacagaaucugcacaggcauuacguccucuaauagcccccacguggugaaaaccgccacacagggggaaaucaacgucaccggagugauuccucugacaaccacaccgaccaagucccauuucgcgaaucuuaaaggcacgaagacccgggggaaacugugucccaagugccucaacuguacagaucuggacguugcucuuggacgcccuaagugcaccggcaauauccccucugccaaagugagcauccugcacgaagucagaccugugacauccggguguuuucccauuaugcaugaucggaccaagauccgccaacucccuaaccugcugagaggauacgagcacauucggcucucuacgcauaauguuaucaacgccgaaaaagcuccgggcggccccuauaagauugggacaagcggauccugcccuaaugugaccaacggcaauggguucuuugccacaauggcuugggccguccccaaaaacgacaauaacaagaccgcgaccaauagccugacaaucgaggugccucacauuuguacggaaggagaggaucagaucaccguguggggcuuccacucugacaacgagauccagauggccaaacuuuacggggauuccaagccccagaaguuuacaagcucugcuaacggagucaccacacauuauauuucccaaaucggcggcuucccgaaucagaccgaagacgggggacugccucagagcggccgcauuguuguggauuacauggugcagaaaucugggaagacgggaacaaucaccuaucaaagaggcauucuccugccccagaaagucuggugcgccuccgggcggagcaaggugaucaaaggaucccuuccucugaucggcgaggcugacugucuccacgaaaaguacggcgggcugaacaagucuaaacccuauuacaccggagagcaugccaaggcgauuggcaauugccccaucuggguuaaaacaccucugaagcucgccaacgggaccaaauaccgcccgcccgcuaagcugcuuaaggagagaggauuuuucggcgccauugcuggguuucuggaaggcggaugggagggcaugaucgccggguggcacggauauacaagccacggcgcccaugggguggcugucgcggccgaucucaaauccacgcaggaagcuauuaauaagaucaccaaaaaccugaauagccuuucugagcuggaagugaagaaccuccagcggcuguccggagccauggacgagcugcacaaugagauccucgaacuggaugagaaaguugacgaccuucgcgccgauacaauuagcucucaaaucgaacuggcugugcuccugagcaacgagggcauuaucaauuccgaagacgagcaucuucuggcccucgagagaaagcugaagaaaaugcuggggccuucugcgauugaaaucggcaacggauguuucgagaccaagcacaaaugcaaucagacaugccucgaucggauugcugccggcaccuuugacgccggggaguucagccugcccacguuugauucccuuaacaucaccgcugccagccugaaugacgauggacucgacaaccauacaauccugcuguacuauucuaccgcugccuccagccuugcggucacacucaugauugccaucuucguggucuacauggugucucgcgauaacguuuccuguagcauuugccuguga

SEQ ID NO: 210133 - RNA, 1758 nt, Artificial Sequence; identical to SEQ ID NO: 210114
  derived and/or modified sequence opt5 from hemagglutinin__InfluenzaB__AGX17116

SEQ ID NO: 210134 - RNA, 1758 nt, Artificial Sequence
  derived and/or modified sequence opt5 from hemagglutinin__InfluenzaB__AGX17127
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccgaaucccauuucgcgaaucuuaagggcacgaaaacccgggggaagcugugucccaaaugccucaacuguacagaucuggacguggcucuuggacgcccuaagugcaccggcaauauucccucugccaaggucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccgucuggggcuuccacucugacaacgaaaaccagauggccaaacuuuauggggauuccaagccccagaaguuuacaagcucugcuaauggaguuaccacacacuacgugucccaaaucggcggcuucccgaaccagaccgaggacgggggacugccucagagcggccgcaucguggucgauuauauggugcagaagucugggaauacgggaacaauuaccuaccaaagaggcauccuccugccccagaaaguuuggugcgccuccgggcggagcaaggugauuaaaggaucccuuccucugaucggcgaagcugacugucuccaugagaaguauggcgggcugaacaaaucuaagcccuacuacaccggagagcacgccaaggcgauuggcaauugccccaucugggucaaaacaccucugaagcucgccaacgggaccaaauaucgcccgcccgcuaagcugcuuaaagaaagaggauuuuucggcgccaucgcuggguuucuggagggcggaugggaaggcaugauugccggguggcauggauacacaagccacggcgcccacgggguggcuguugcggccgaucucaaguccacgcaggaggcuaucaauaagauuaccaaaaaccugaauagccuuucugaacuggaggugaagaaccuccagcggcuguccggagccauggacgagcugcauaaugaaauccucgagcuggaugaaaaagucgacgaccuucgcgccgauacaauuagcucucaaaucgagcuggcugugcuccugagcaacgaaggcaucauuaauuccgaggacgagcaccuucuggcccucgaaagaaagcugaaaaagaugcuggggccuucugcggucgagaucggcaacggauguuucgaaaccaagcauaaaugcaaucagacaugccucgaucggauugcugccggcaccuuugacgccggggaguucagccugcccacguuugauucccuuaacaucaccgcugccagccugaacgacgauggacucgacaaucacacaauucugcuguauuacucuaccgcugccuccagccuugcggugacacucaugaucgccauuuucguuguguauauggucucucgcgauaacguguccuguagcaucugccuguga

SEQ ID NO: 210135 - RNA, 1758 nt, Artificial Sequence; identical to SEQ ID NO: 210123
  derived and/or modified sequence opt5 from hemagglutinin__InfluenzaB__AGX17138

SEQ ID NO: 210136 - RNA, 1758 nt, Artificial Sequence; identical to SEQ ID NO: 210123
  derived and/or modified sequence opt5 from hemagglutinin__InfluenzaB__AGX17149

SEQ ID NO: 210137 - RNA, 1758 nt, Artificial Sequence
  derived and/or modified sequence opt5 from hemagglutinin__InfluenzaB__AGX17160
augaaggccaucauugugcugcucauggucguuaccagcaacgcugacagaaucugcacaggcauuacguccucuaauagcccccacguggugaaaaccgccacacagggggaagucaacgugaccggaaugaucccucugacaaccacaccgaccaagucccauuucgcgaaucuuaaaggcacgaagacccgggggaaacugugucccaagugccucaacuguacagaucuggacguugcucuuggacgcccuaagugcaccggcaauauucccucugccaaagugagcauccugcacgaagucagaccugugacauccggguguuuucccaucaugcaugaucggaccaagauucgccaacucccuaaccugcugagaggauacgagcacauccggcucucuacgcauaauguuauuaacgccgaaaaagcuccgggcggccccuauaagaucgggacaagcggauccugcccuaaugugaccaacggcaauggguucuuugccacaauggcuugggccguccccaaaaacgacaauaacaagaccgcgaccaauagccugacaauugaggugccuuacaucuguacggaaggagaggaucagauuaccguguggggcuuccacucugacaacgagacacagauggccaaacuuuauggggauuccaaaccccagaaguuuaccagcucugcuaacggagucacaacccacuacguuucccaaaucggcggcuucccgaaucagacggaagacgggggacugccucagagcggccgcaucgugguggauuauaugguccagaaaucugggaagacaggaaccauuaccuaccaaagaggcauccuccugccccagaaaguguggugcgccuccgggcggagcaagguuauuaaaggaucccuuccucugaucggcgaggcugacugucuccaugaaaaguauggcgggcugaacaagucuaaacccuacuacacaggagagcacgccaaggcgauuggcaauugccccaucugggugaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacggggucgcuguggcggccgaucucaaauccacccaggaagcuaucaauaagauuacaaagaaccugaauagccuuucugagcuggaaguuaagaaccuccagcggcuguccggagccauggacgagcugcauaaugagauccucgaacuggaugagaaaguggacgaccuucgcgccgauaccauuagcucucaaaucgaacuggcuguccuccugagcaacgagggcaucauuaauuccgaagacgagcaccuucuggcccucgagagaaagcugaagaaaaugcuggggccuucugcgguggaaaucggcaacggauguuucgagacaaagcauaaaugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggucacccucaugaucgccauuuucgugguuuauauggugucucgcgauaacgucuccuguagcaucugccuguga

SEQ ID NO: 210138 - RNA, 1758 nt, Artificial Sequence
  derived and/or modified sequence opt5 from hemagglutinin__InfluenzaB__AGX17171
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccgaaucccauuucgcgaaucuuaagggcacgaaaacccgggggaagcugugucccaaaugccucaacuguacagaucuggacguggcucuuggacgcccuaagugcaccggcaauauucccucugccaaggucagcauccugcacgaggugagaccuguuacauccggguguuuucccaucaugcauaaccggaccaaaauucgccaacucccuaaucugcugagaggauacgaacacauccggcucucuacgcauaacgugauuaaugccgagaaggcuccgggcggccccuauaaaaucgggacaagcggauccugcccuaacgucaccaauggcaacggguucuuugccacaauggcuugggccgugcccaagaaugauaacaauaaaaccgcgaccaacagccugacaauugaagugccuuacaucuguacggagggagaggaccagauuaccgucuggggcuuccacucugauaacgaagcccagauggcuaaacuuuauggggacuccaagccccagaaguuuacaagcucugccaauggaguuaccacacacuacgugucccaaaucggcggcuucccgaaccagaccgaggaugggggacugccucagagcggccgcaucguggucgacuauauggugcagaagucugggaauacgggaacaauuaccuaccaaagaggcauccuccugccccagaaaguuuggugcgcuuccgggcggagcaaggugauuaaaggaucccuuccucugaucggcgaagccgauugucuccaugagaaguauggcgggcugaacaaaucuaagcccuacuacaccggagagcacgcgaaggccauuggcaauugccccaucugggucaaaacaccucugaagcucgcuaacgggaccaaauaucgcccgcccgccaagcugcuuaaagaaagaggauuuuucggcgcuaucgccggguuucuggagggcggaugggaaggcaugauugccggguggcauggauacacaagccacggcgcucacgggguggcgguugccgcugaccucaaguccacgcaggaggccaucaauaagauuaccaaaaaccugaauagccuuucugaacuggaggugaagaaccuccagcggcuguccggagccauggaugagcugcauaaugaaauccucgagcuggacgaaaaagucgaugaccuucgcgcugacacaauuagcucucaaaucgagcuggccgugcuccugagcaacgaaggcaucauuaauuccgaggaugagcaccuucuggcgcucgaaagaaagcugaaaaagaugcuggggccuucugcugucgagaucggcaacggauguuucgaaaccaagcauaaaugcaaucagacaugccucgaccggauugccgccggcaccuuugaugcuggggaguucagccugcccacguuugacucccuuaacaucaccgccgcuagccugaacgaugacggacucgauaaucacacaauucugcuguauuacucuaccgccgcguccagccuugccgugacacucaugaucgcuauuuucguuguguauauggucucucgcgacaacguguccuguagcaucugccuguga

SEQ ID NO: 210139 - RNA, 1758 nt, Artificial Sequence; identical to SEQ ID NO: 210003
  derived and/or modified sequence opt5 from hemagglutinin__InfluenzaB__AGX17182

SEQ ID NO: 210140 - RNA, 1758 nt, Artificial Sequence; identical to SEQ ID NO: 210003
  derived and/or modified sequence opt5 from hemagglutinin__InfluenzaB__AGX17193

SEQ ID NO: 210141 - RNA, 1758 nt, Artificial Sequence; identical to SEQ ID NO: 210003
  derived and/or modified sequence opt5 from hemagglutinin__InfluenzaB__AGX17204

SEQ ID NO: 210142 - RNA, 1758 nt, Artificial Sequence
  derived and/or modified sequence opt5 from hemagglutinin__InfluenzaB__AGX17215
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgaggcccagauggcuaaacuuuauggggauuccaagccccagaaguuuacaagcucugccaacggaguuaccacacacuacgugucccaaaucggcggcuucccgaaucagaccgaagacgggggacugccucagagcggccgcaucguggucgauuauauggugcagaaaucugggaagacgggaacaauuaccuaccaaagaggcauccuccugccccagaaaguuuggugcgcuuccgggcggagcaaggugauuaaaggaucccuuccucugaucggcgaggccgacugucuccaugaaaaguauggcgggcugaacaagucuaaacccuacuacaccggagagcacgcgaaggccauuggcaauugccccaucugggucaaaacaccucugaagcucgcuaacgggaccaaauaucgcccgcccgccaagcugcuuaaggagagaggauuuuucggcgcuaucgccggguuucuggaaggcggaugggagggcaugauugccggguggcauggauacacaagccacggcgcucacgggguggcgguugccgcugaucucaaauccacgcaggaagccaucaauaagauuaccaaaaaccugaauagccuuucugagcuggaagugaagaaccuccagcggcuguccggagccauggacgagcugcauaaugagauccucgaacuggaugagaaagucgacgaccuucgcgcugauacaauuagcucucaaaucgaacuggccgugcuccugagcaacgagggcaucauuaauuccgaagacgagcaccuucuggcgcucgagagaaagcugaagaaaaugcuggggccuucugcuaucgaaauuggcaacggauguuucgagaccaagcauaaaugcaaucagacaugccucgaucggaucgccgccggcaccuuugacgcuggggaguucagccugcccacguuugauucccuuaacauuaccgccgcuagccugaaugacgauggacucgacaaccacacaauccugcuguauuacucuaccgccgcguccagccuugccgucacacucaugauugcuaucuucgugguuuauauggugucucgcgauaacgucuccuguagcaucugccuguga

SEQ ID NO: 210143 - RNA, 1758 nt, Artificial Sequence; identical to SEQ ID NO: 210003
  derived and/or modified sequence opt5 from hemagglutinin__InfluenzaB__AGX17226

SEQ ID NO: 210144 - RNA, 1758 nt, Artificial Sequence
  derived and/or modified sequence opt5 from hemagglutinin__InfluenzaB__AGX17237
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaauauuaccaacggcaauggguucuuugccacaauggcuugggccguccccaaaaacgacaauaacaagaccgcgaccaauagccugacaaucgaggugccuuacauuuguacggaaggagaggaucagaucaccguguggggcuuccacucugacaacgagauccagauggccaaacuuuauggggauuccaagccccagaaguuuacaagcucugcuaacggagucaccacacacuacguuucccaaauuggcggcuucccgaaucagaccgaagacgggggacugccucagagcggccgcaucgugguggauuauaugguccagaaaucugggaagacgggaacaauuaccuaccaaagaggcauccuccugccccagaaaguguggugcgccuccgggcggagcaagguuauuaaaggaucccuuccucugaucggcgaggcugacugucuccaugaaaaguauggcgggcugaacaagucuaaacccuacuacaccggagagcacgccaaggcgaucggcaauugccccauuugggugaaaacaccucugaagcucgccaacgggaccaaauaucgcccgcccgcuaagcugcuuaaggagagaggauuuuucggcgccaucgcuggguuucuggaaggcggaugggagggcaugauugccggguggcauggauacacaagccacggcgcccacggggucgcuguggcggccgaucucaaauccacgcaggaagcuaucaauaagauuaccaaaaaccugaauagccuuucugagcuggaaguuaagaaccuccagcggcuguccggagccauggacgagcugcauaaugagauccucgaacuggaugagaaaguggacgaccuucgcgccgauacaaucagcucucaaauugaacuggcuguccuccugagcaacgagggcaucauuaauuccgaagacgagcaccuucuggcccucgagagaaagcugaagaaaaugcuggggccuucugcgguggaaaucggcaacggauguuucgagaccaagcauaaaugcaaucagacaugccucgaucggauugcugccggcaccuuugacgccggggaguucagccugcccacguuugauucccuuaacaucaccgcugccagccugaaugacgauggacucgacaaccacacaauucugcuguauuacucuaccgcugccuccagccuugcggucacacucaugaucgccaucuucgugguuuauauggugucucgcgauaacgucuccuguagcauuugccuguga

SEQ ID NO: 210145 - RNA, 1758 nt, Artificial Sequence
  derived and/or modified sequence opt5 from hemagglutinin__InfluenzaB__AGX17248
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaagccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcacauccgggcggagcaaggugauuaaaggaucccuuccucugaucggcgaggccgacugucuccaugaaaaguauggcgggcugaacaagucuaaacccuacuacaccggagagcacgcuaaggccauuggcaauugccccaucugggucaaaacaccucugaagcucgcgaacgggacgaaauaucgcccgcccgccaagcugcuuaaggagagaggauuuuucggcgcuaucgccggguuucuggaaggcggaugggagggcaugauugcuggguggcauggauacaccagccacggcgcccacgggguggccguugcugcggaucucaaauccacacaggaagccaucaauaagauuaccaaaaaccugaauagccuuucugagcuggaagugaagaaccuccagcggcuguccggagcuauggacgagcugcauaaugagauccucgaacuggaugagaaagucgacgaccuucgcgccgauacaauuagcucucaaaucgaacuggccgugcuccugagcaacgagggcaucauuaauuccgaagacgagcaccuucuggcucucgagagaaagcugaagaaaaugcuggggccuucugccgucgaaaucggcaacggauguuucgagaccaagcauaaaugcaaucagacgugccucgaucggauugcggcuggcaccuuugacgccggggaguucagccugcccacauuugauucccuuaacaucaccgccgcuagccugaaugacgauggacucgacaaccacacaauucugcuguauuacucuaccgccgcuuccagccuugccgugacgcucaugaucgcgauuuucguuguguauauggucucucgcgauaacguguccuguagcaucugccuguga

SEQ ID NO: 210146 - RNA, 1758 nt, Artificial Sequence; identical to SEQ ID NO: 210087
  derived and/or modified sequence opt5 from hemagglutinin__InfluenzaB__AGX17270

SEQ ID NO: 210147 - RNA, 1758 nt, Artificial Sequence; identical to SEQ ID NO: 210003
  derived and/or modified sequence opt5 from hemagglutinin__InfluenzaB__AGX17281

SEQ ID NO: 210148 - RNA, 1758 nt, Artificial Sequence; identical to SEQ ID NO: 210003
  derived and/or modified sequence opt5 from hemagglutinin__InfluenzaB__AGX17292

SEQ ID NO: 210149 - RNA, 1758 nt, Artificial Sequence; identical to SEQ ID NO: 210003
  derived and/or modified sequence opt5 from hemagglutinin__InfluenzaB__AGX17303

SEQ ID NO: 210150 - RNA, 1758 nt, Artificial Sequence; identical to SEQ ID NO: 210129
  derived and/or modified sequence opt5 from hemagglutinin__InfluenzaB__AGX17314

SEQ ID NO: 210151 - RNA, 1758 nt, Artificial Sequence; identical to SEQ ID NO: 210003
  derived and/or modified sequence opt5 from hemagglutinin__InfluenzaB__AGX17325

SEQ ID NO: 210152 - RNA, 1758 nt, Artificial Sequence; identical to SEQ ID NO: 210114
  derived and/or modified sequence opt5 from hemagglutinin__InfluenzaB__AGX17336

SEQ ID NO: 210153 - RNA, 1758 nt, Artificial Sequence; identical to SEQ ID NO: 210003
  derived and/or modified sequence opt5 from hemagglutinin__InfluenzaB__AGX17347

SEQ ID NO: 210154 - RNA, 1758 nt, Artificial Sequence; identical to SEQ ID NO: 210003
  derived and/or modified sequence opt5 from hemagglutinin__InfluenzaB__AGX17358

SEQ ID NO: 210155 - RNA, 1758 nt, Artificial Sequence
  derived and/or modified sequence opt5 from hemagglutinin__InfluenzaB__AGX17369
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaaaccccagaaguuuaccagcucugcuaacggaguuacaacccacuacgugucccaaaucggcggcuucccgaaucagacggaagacgggggacugccucagagcggccgcaucguggccgauuauaugguccagaaaucugggaagacaggaaccauuaccuaccaaagaggcauccuccugccccagaaaguguggugcgcuuccgggcggagcaagguuauuaaaggaucccuuccucugaucggcgaggccgacugucuccaugaaaaguauggcgggcugaacaagucuaaacccuacuacacaggagagcacgcgaaggccauuggcaauugccccaucugggugaaaaccccucugaagcucgcuaacgggacaaaauaucgcccgcccgccaagcugcuuaaggagagaggauuuuucggcgcuaucgccggguuucuggaaggcggaugggagggcaugauugccggguggcauggauacacgagccacggcgcucacggggucgcgguggccgcugaucucaaauccacccaggaagccaucaauaagauuacaaagaaccugaauagccuuucugagcuggaaguuaagaaccuccagcggcuguccggagccauggacgagcugcauaaugagauccucgaacuggaugagaaaguggacgaccuucgcgcugauaccauuagcucucaaaucgaacuggccguccuccugagcaacgagggcaucauuaauuccgaagacgagcaccuucuggcgcucgagagaaagcugaagaaaaugcuggggccuucugcuguggaaaucggcaacggauguuucgagacaaagcauaaaugcaaucagaccugccucgaucggauugccgccggcacguuugacgcuggggaguucagccugcccaccuuugauucccuuaacaucacagccgcuagccugaaugacgauggacucgacaaccacaccauucugcuguauuacucuacagccgcguccagccuugccgucacccucaugaucgcuauuuucgugguuuauauggugucucgcgauaacgucuccuguagcaucugccuguga

SEQ ID NO: 210156 - RNA, 1758 nt, Artificial Sequence; identical to SEQ ID NO: 210129
  derived and/or modified sequence opt5 from hemagglutinin__InfluenzaB__AGX17380

SEQ ID NO: 210157 - RNA, 1758 nt, Artificial Sequence; identical to SEQ ID NO: 210003
  derived and/or modified sequence opt5 from hemagglutinin__InfluenzaB__AGX17391

SEQ ID NO: 210158 - RNA, 1758 nt, Artificial Sequence
  derived and/or modified sequence opt5 from hemagglutinin__InfluenzaB__AGX17400
augaaggccaucauugugcugcucauggucguuaccagcaacgcugacagaaucugcacaggcauuacguccucuaauagcccccacauggugaaaaccgccacacagggggaagugaacgucaccggagugaucccucugacaaccacaccgaccaagucccauuucgcgaaucuuaaaggcacgaagacccgggggaaacugugucccaagugccucaacuguacagaucuggacguugcucuuggacgcccuaagugcaccggcaauauucccucugccaaagugagcauccugcacgaagucagaccugugacauccggguguuuucccaucaugcaugaucggaccaagauucgccaacucccuaaccugcugagaggauacgagcacauccggcucucuacgcauaauguuauuaacgccgaaaaagcuccgggcggccccuauaagaucgggacaagcggauccugcccuaaugugaccaacggcaauggguucuuugccacaauggcuugggccguccccaaaaacgacaauaacaagaccgcgaccaauagccugacaauugaggugccuuacaucuguacggaaggagaggaucagauuaccguguggggcuuccacucugacaacgagacacagauggccaaacuuuauggggauuccaaaccccagaaguuuaccagcucugcuaacggagucacaacccacuacguuucccaaaucggcggcuucccgaaucagacggaagacgggggacugccucagagcggccgcaucgugguggauuauaugguccagaaaucugggaagacaggaaccauuaccuaccaaagaggcauccuccugccccagaaaguguggugcgccuccgggcggagcaagguuauuaaaggaucccuuccucugaucggcgaggcugacugucuccaugaaaaguauggcgggcugaacaagucuaaacccuacuacacaggagagcacgccaaggcgauuggcaauugccccaucugggugaaaaccccucugaagcucgccaacgggacaaaauaucgcccgcccgcuaagcugcuuaaggagagaggauuuuucggcgccaucgcuggguuucuggaaggcggaugggagggcaugauugccggguggcauggauacacgagccacggcgcccacggggucgcuguggcggccgaucucaaauccacccaggaagcuaucaauaagauuacaaagaaccugaauagccuuucugagcuggaaguuaagaaccuccagcggcuguccggagccauggacgagcugcauaaugagauccucgaacuggaugagaaaguggacgaccuucgcgccgauaccauuagcucucaaaucgaacuggcuguccuccugagcaacgagggcaucauuaauuccgaagacgagcaccuucuggcccucgagagaaagcugaagaaaaugcuggggccuucugcgguggaaaucggcaacggauguuucgagacaaagcauaaaugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggucacccucaugaucgccauuuucgugguuuauauggugucucgcgauaacgucuccuguagcaucugccuguga

SEQ ID NO: 210159 - RNA, 1758 nt, Artificial Sequence; identical to SEQ ID NO: 210003
  derived and/or modified sequence opt5 from hemagglutinin__InfluenzaB__AGX17411

SEQ ID NO: 210160 - RNA, 1758 nt, Artificial Sequence; identical to SEQ ID NO: 210003
  derived and/or modified sequence opt5 from hemagglutinin__InfluenzaB__AGX17422

SEQ ID NO: 210161 - RNA, 1758 nt, Artificial Sequence; identical to SEQ ID NO: 210086
  derived and/or modified sequence opt5 from hemagglutinin__InfluenzaB__AGX17433

SEQ ID NO: 210162 - RNA, 1758 nt, Artificial Sequence; identical to SEQ ID NO: 210003
  derived and/or modified sequence opt5 from hemagglutinin__InfluenzaB__AGX17444

SEQ ID NO: 210163 - RNA, 1758 nt, Artificial Sequence; identical to SEQ ID NO: 210086
  derived and/or modified sequence opt5 from hemagglutinin__InfluenzaB__AGX17455

SEQ ID NO: 210164 - RNA, 1758 nt, Artificial Sequence; identical to SEQ ID NO: 210129
  derived and/or modified sequence opt5 from hemagglutinin__InfluenzaB__AGX17466

SEQ ID NO: 210165 - RNA, 1758 nt, Artificial Sequence; identical to SEQ ID NO: 210003
  derived and/or modified sequence opt5 from hemagglutinin__InfluenzaB__AGX17477

SEQ ID NO: 210166 - RNA, 1758 nt, Artificial Sequence; identical to SEQ ID NO: 210088
  derived and/or modified sequence opt5 from hemagglutinin__InfluenzaB__AGX17488

SEQ ID NO: 210167 - RNA, 1758 nt, Artificial Sequence; identical to SEQ ID NO: 210003
  derived and/or modified sequence opt5 from hemagglutinin__InfluenzaB__AGX17499

SEQ ID NO: 210168 - RNA, 1758 nt, Artificial Sequence; identical to SEQ ID NO: 210129
  derived and/or modified sequence opt5 from hemagglutinin__InfluenzaB__AGX17510

SEQ ID NO: 210169 - RNA, 1758 nt, Artificial Sequence; identical to SEQ ID NO: 210129
  derived and/or modified sequence opt5 from hemagglutinin__InfluenzaB__AGX17521

SEQ ID NO: 210170 - RNA, 1758 nt, Artificial Sequence; identical to SEQ ID NO: 210131
  derived and/or modified sequence opt5 from hemagglutinin__InfluenzaB__AGX17532

SEQ ID NO: 210171 - RNA, 1758 nt, Artificial Sequence
  derived and/or modified sequence opt5 from hemagglutinin__InfluenzaB__AGX17543
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgucucuuaaaggcacgaagacccgggggaaacugugucccaagugccucaauuguacagaucuggacguggcucuuggacgcccuaagugcaccggcaacauucccagcgccaaagucuccauccugcacgaagugagaccuguuacaucuggguguuuucccaucaugcaugaucggaccaagauucgccaacucccuaaucugcugagaggauacgagcacauccggcucagcacgcauaacgugauuaaugccgaaaaagcuccgggcggccccuauaagaucgggacauccggaagcugcccuaacgucaccaauggcaacggguucuuugccacaauggcuugggccgugcccaaaaaugacaacaauaagaccgcgaccaacucucugacaauugaggugccuuacaucuguacggaaggagaggaucagauuaccgucuggggcuuccacuccgacaaugagacacagauggccaaacuuuauggggauagcaaaccccagaaguuuaccucuuccgcuaacggaguuacaacccacuacgugagccaaaucggcggcuucccgaaccagacggaagacgggggacugccucagucuggccgcaucguggucgauuauauggugcagaaauccgggaagacaggaaccauuaccuaccaaagaggcauccuccugccccagaaaguuuggugcgccagcgggcgguccaaggugauuaaaggaucucuuccucugaucggcgaggcugacugucuccaugaaaaguauggcgggcugaauaagagcaaacccuacuacacaggagagcacgccaaggcgauuggcaacugccccaucugggucaaaaccccucugaagcucgccaaugggacaaaauaucgcccgcccgcuaagcugcuuaaggagagaggauuuuucggcgccaucgcuggguuucuggaaggcggaugggagggcaugauugccggguggcauggauacacgucccacggcgcccacgggguggcuguugcggccgaucucaaaagcacccaggaagcuaucaacaagauuacaaagaaucugaacucucuuuccgagcuggaagugaagaaucuccagcggcugagcggagccaugaacgagcugcauaaugagauccucgaacuggacgagaaagucgaugaccuucgcgccgacaccauuucuagccaaaucgaacuggcugugcuccuguccaacgagggcaucauuaauucugaagaugagcaccuucuggcccucgagagaaagcugaagaaaaugcuggggccuagcgcggucgaaaucggcaacggauguuucgagacaaagcauaaaugcaaucagaccugccucgaccggauugcugccggcacguuugaugccggggaguucucccugcccaccuuugacagccuuaacaucacagcugccucucugaaugaugacggacucgauaaccacaccauucugcuguauuacuccacagcugccagcucucuugcggugacccucaugaucgccauuuucguuguguauauggucucccgcgacaacgugagcuguuccaucugccuguga

SEQ ID NO: 210172 - RNA, 1758 nt, Artificial Sequence
  derived and/or modified sequence opt5 from hemagglutinin__InfluenzaB__AGX17554
augaaggccaucauugugcugcuccuggucguuaccagcaacgcugacagaaucugcacaggcauuacguccucuaauagcccccacguggugaaaaccgccacacagggggaagucaacgugaccggaguuaucccucuuacaaccacaccgaccaagucccauuucgcgaaucugaaaggcacgaagacccgggggaaacucugucccaagugccugaacuguacagaucuugacguggcucugggacgcccuaagugcaccggcaauauucccucugccaaagucagcauccuccacgaagugagaccuguuacauccggguguuuucccaucaugcaugaucggaccaagauucgccaacugccuaaccugcucagaggauacgagcacauccggcugucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccuuacaauugaggugccuuacaucuguacggaaggagaggaucagauuaccgucuggggcuuccacucugacaacgagacacagauggccaagcuguauggggauuccaaaccccagaaguuuaccagcucugcuaacggaguuacaacccacuacgugucccaaaucggcggcuucccgaaucagacggaagacgggggacucccucagagcggccgcaucguggucgauuauauggugcagaaaucugggaagacaggaaccauuaccuaccaaagaggcauccugcuuccccagaaaguuuggugcgccuccgggcggagcaaggugauuaaaggaucccugccucucaucggcgaggcugacugucugcaugaaaaguauggcgggcugaacaagucuaaacccuacuacacaggagagcacgccaaggcgauuggcaauugccccaucugggucaaaaccccucucaagcuggccaacgggacaaaauaucgcccgcccgcuaaacuucugaaggagagaggauuuuucggcgccaucgcuggguuucucgaaggcggaugggagggcaugauugccggguggcauggauacacgagccacggcgcccacgggguggcuguugcggccgaucugaaauccacccaggaagcuaucaauaagauuacaaagaaccuuaauagccugucugagcucgaagugaagaaccugcagcggcuguccggagccauggacgagcuccauaaugagauccuggaacuugaugagaaagucgacgaccugcgcgccgauaccauuagcucucaaaucgaacucgcugugcugcuuagcaacgagggcaucauuaauuccgaagacgagcaucugcucgcccuggagagaaagcugaagaaaaugcucgggccuucugcggucgaaaucggcaacggauguuucgagacaaagcacaaaugcaaucagaccugccuggaucggauugcugccggcacguuugacgccggggaguucagccuucccaccuuugauucccugaacaucacagcugccagccucaaugacgauggacuggacaaccacaccauucugcuuuauuacucuacagcugccuccagccucgcggugacccugaugaucgccauuuucguuguguauauggucucucgcgauaacguguccuguagcaucugccuguga

SEQ ID NO: 210173 - RNA, 1755 nt, Artificial Sequence; identical to SEQ ID NO: 210047
  derived and/or modified sequence opt5 from hemagglutinin__InfluenzaB__AGX17565

SEQ ID NO: 210174 - RNA, 1758 nt, Artificial Sequence
  derived and/or modified sequence opt5 from hemagglutinin__InfluenzaB__AGX17576
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcggcuguccggagccauggacgagcugcauaaugaaauucucgagcuggaugaaaagguggacgaccuucgcgccgauaccaucagcucucaaaucgagcuggcuguccuccugagcaacgaaggcauuaucaauuccgaggacgagcaccuucuggcccucgaaagaaaacugaagaagaugcuggggccuucugcgguggagauuggcaacggauguuucgaaacaaaacauaagugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauggccauuuucgugguuuauauggugucucgcgauaacgucuccuguagcaucugccuguga

SEQ ID NO: 210175 - RNA, 1758 nt, Artificial Sequence; identical to SEQ ID NO: 209538
  derived and/or modified sequence opt5 from hemagglutinin__InfluenzaB__AGX17598

SEQ ID NO: 210176 - RNA, 1758 nt, Artificial Sequence
  derived and/or modified sequence opt5 from hemagglutinin__InfluenzaB__AGX17609
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaagcugacugucuccaugagaaguauggcgggcugaacaaaucuaagcccuacuacacaggagagcacgccaaggcgauuggcaauugccccaucugggucaaaaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgagccacggcgcccacgggguggcuguugcggccgaucucaaguccacccaggaggcuaucaauaagauuaccaaaaaccugaauagccuuucugaacuggaggugaagaaccuccagcgccuguccggagccauggacgagcugcauaaugaaauccucgagcuggaugaaaaagucgacgaccuuagagccgauacaauuagcucucaaaucgagcuggcugugcuccugagcaacgaaggcaucauuaauuccgaggacgagcaccuucuggcccucgaacggaagcugaaaaagaugcuggggccuucugcggucgagaucggcaacggauguuucgaaacaaagcauaaaugcaaucagaccugccucgaucgcauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucuagagauaacguguccuguagcaucugccuguga

SEQ ID NO: 210177 - RNA, 1758 nt, Artificial Sequence; identical to SEQ ID NO: 210005
  derived and/or modified sequence opt5 from hemagglutinin__InfluenzaB__AGX17620

SEQ ID NO: 210178 - RNA, 1758 nt, Artificial Sequence; identical to SEQ ID NO: 209538
  derived and/or modified sequence opt5 from hemagglutinin__InfluenzaB__AGX17631

SEQ ID NO: 210179 - RNA, 1758 nt, Artificial Sequence; identical to SEQ ID NO: 209662
  derived and/or modified sequence opt5 from hemagglutinin__InfluenzaB__AGX17642

SEQ ID NO: 210180 - RNA, 1758 nt, Artificial Sequence; identical to SEQ ID NO: 210005
  derived and/or modified sequence opt5 from hemagglutinin__InfluenzaB__AGX17653

SEQ ID NO: 210181 - RNA, 1758 nt, Artificial Sequence; identical to SEQ ID NO: 209538
  derived and/or modified sequence opt5 from hemagglutinin__InfluenzaB__AGX17664

SEQ ID NO: 210182 - RNA, 1758 nt, Artificial Sequence; identical to SEQ ID NO: 209662
  derived and/or modified sequence opt5 from hemagglutinin__InfluenzaB__AGX17675

SEQ ID NO: 210183 - RNA, 1758 nt, Artificial Sequence; identical to SEQ ID NO: 210005
  derived and/or modified sequence opt5 from hemagglutinin__InfluenzaB__AGX17686

SEQ ID NO: 210184 - RNA, 1758 nt, Artificial Sequence
  derived and/or modified sequence opt5 from hemagglutinin__InfluenzaB__AGX17697
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcgagauucccucugccagagucagcauccugcacgaagugcggccuguuacauccggguguuuucccaucaugcaugaucgcaccaagauuagacaacucccuaaucugcugcggggauacgagcacauccgccucucuacgcauaacgccauuaaugcugaaaacgccccgggcggccccuauaaaaucgggacaagcggauccugcccuaaugugaccaacggcaauggguucuuugcuacaauggccugggcgguccccaagaacgacaauaacaaaaccgccaccaauagccugacaauugaggugccuuacaucuguacggagggagaagaucagauuaccguguggggcuuccacucugacaacgagacacagauggcuaaacuuuauggggauuccaagccccagaaguuuaccagcucugccaacggagucacaacccacuacguuucccaaaucggcggcuucccgaaucagacggaagacgggggacugccucagagcggcagaaucgugguggauuauaugguccagaagucugggaaaacaggaaccauuaccuaccaacggggcauccuccugccccagaagguguggugcgcuuccgggcgcagcaaaguuauuaagggaucccuuccucugaucggcgaggccgacugucuccaugagaaauauggcgggcugaacaagucuaaacccuacuacacaggagaacacgcgaaggccauuggcaauugccccaucugggugaagaccccucugaaacucgcuaacgggacaaaguauagaccgcccgccaaacugcuuaaggagcggggauuuuucggcgcuaucgccggguuucuggaaggcggaugggagggcaugauugccggguggcauggauacacgagccacggcgcucacggggucgcgguggccgcugaucucaaauccacccaggaagccaucaauaagauuacaaagaaccugaauagccuuucugagcuggagguuaaaaaccuccagcgccuguccggagccauggacgaacugcauaaugagauccucgaacuggaugagaagguggacgaccuuagagcugauaccauuagcucucaaaucgaacuggccguccuccugagcaacgagggcaucauuaauuccgaggacgaacaccuucuggcgcucgagcggaaacugaagaaaaugcuggggccuucugcuguggaaaucggcaacggauguuucgagacaaagcauaagugcaaucagaccugccucgaucgcauugccgccggcacguuugacgcuggggaguucagccugcccaccuuugauucccuuaacaucacagccgcuagccugaaugacgauggacucgacaaccacaccauucugcuguauuacucuacagccgcguccagccuugccgucacccucaugaucgcuauuuucgugguuuauauggugucuagagauaacgucuccuguagcaucugccuguga

SEQ ID NO: 210185 - RNA, 1758 nt, Artificial Sequence; identical to SEQ ID NO: 209662
  derived and/or modified sequence opt5 from hemagglutinin__InfluenzaB__AGX17708

SEQ ID NO: 210186 - RNA, 1758 nt, Artificial Sequence; identical to SEQ ID NO: 210005
  derived and/or modified sequence opt5 from hemagglutinin__InfluenzaB__AGX17719

SEQ ID NO: 210187 - RNA, 1758 nt, Artificial Sequence; identical to SEQ ID NO: 209662
  derived and/or modified sequence opt5 from hemagglutinin__InfluenzaB__AGX17730

SEQ ID NO: 210188 - RNA, 1758 nt, Artificial Sequence; identical to SEQ ID NO: 209538
  derived and/or modified sequence opt5 from hemagglutinin__InfluenzaB__AGX17741

SEQ ID NO: 210189 - RNA, 1758 nt, Artificial Sequence; identical to SEQ ID NO: 210005
  derived and/or modified sequence opt5 from hemagglutinin__InfluenzaB__AGX17752

SEQ ID NO: 210190 - RNA, 1758 nt, Artificial Sequence; identical to SEQ ID NO: 210005
  derived and/or modified sequence opt5 from hemagglutinin__InfluenzaB__AGX17774

SEQ ID NO: 210191 - RNA, 1758 nt, Artificial Sequence
  derived and/or modified sequence opt5 from hemagglutinin__InfluenzaB__AGX17785
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacgugcggcucucuacgcauaaugucaucaacgccgagaaggcuccgggcggccccuauaaaauugggacaagcggauccugcccuaaugugaccaacggcaauggguucuuugccacaauggcuugggccgugcccaagaacgacaauaacaaaaccgcgaccaauagccugacaaucgaagucccuuacauuuguacggagggagaggaucagaucaccauuuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggccgcaucguggucgauuauauggugcagaagucugggaaaacaggaaccauuaccuaccaaagaggcauccuccugccccagaagguuuggugcgccuccgggcggagcaaagugauuaagggaucccuuccucugaucggcgaagcugacugucuccaugagaaauauggcgggcugaacaagucuaagcccuacuacacaggagagcacgccaaagcgauuggcaauugccccaucugggucaagaccccucugaaacucgccaacgggacaaaguaucgcccgcccgcuaaacugcuuaaggaaagaggauuuuucggcgccaucgcuggguuucuggagggcggaugggaaggcaugauugccggguggcauggauacacgagccacggcgcccacgggguggcuguugcggccgaucucaaguccacccaggaggcuaucaauaaaauuacaaagaaccugaauagccuuucugaacuggaggugaaaaaccuccagcggcuguccggagccauggacgagcugcauaaugaaauccucgagcuggaugaaaaggucgacgaccuucgcgccgauaccauuagcucucaaaucgagcuggcugugcuccugagcaacgaaggcaucauuaauuccgaggacgagcaccuucuggcccucgaaagaaaacugaagaagaugcuggggccuucugcggucgagaucggcaacggauguuucgaaacaaaacauaagugcaaucagaccugccucgaucggauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucucgcgauaacguguccuguagcaucugccuguga

SEQ ID NO: 210192 - RNA, 1758 nt, Artificial Sequence; identical to SEQ ID NO: 210005
  derived and/or modified sequence opt5 from hemagglutinin__InfluenzaB__AGX17796

SEQ ID NO: 210193 - RNA, 1758 nt, Artificial Sequence; identical to SEQ ID NO: 209589
  derived and/or modified sequence opt5 from hemagglutinin__InfluenzaB__AGX17807

SEQ ID NO: 210194 - RNA, 1758 nt, Artificial Sequence; identical to SEQ ID NO: 210176
  derived and/or modified sequence opt5 from hemagglutinin__InfluenzaB__AGX17818

SEQ ID NO: 210195 - RNA, 1758 nt, Artificial Sequence
  derived and/or modified sequence opt5 from hemagglutinin__InfluenzaB__AGX17829
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaagcugacugucuccaugagaaguauggcgggcugaacaaaucuaagcccuacuacacaggagagcacgccaaggcgauuggcaauugccccaucugggucaaaaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgagccacggcgcccacgggguggcuguugcggccgaucucaaguccacccaggaggcugugaauaagaucaccaaaaaccugaauagccuuucugaacuggaggucaagaaccuccagcgccuguccggagccauggacgagcugcauaaugaaauucucgagcuggaugaaaaaguggacgaccuuagagccgauacaaucagcucucaaauugagcuggcuguccuccugagcaacgaaggcaucaucaauuccgaggacgagcaccuucuggcccucgaacggaagcugaaaaagaugcuggggccuucugcgguggagauuggcaacggauguuucgaaacaaagcauaaaugcaaucagaccugccucgaucgcaucgcugccggcacguuugacgccggggaguucagccugcccaccuuugauucccuuaacauuacagcugccagccugaaugacgauggacucgacaaccacaccauccugcuguauuacucuacagcugccuccagccuugcgguuacccucaugauugccaucuucguggucuauauggugucuagagauaacguuuccuguagcauuugccuguga

SEQ ID NO: 210196 - RNA, 1758 nt, Artificial Sequence; identical to SEQ ID NO: 209662
  derived and/or modified sequence opt5 from hemagglutinin__InfluenzaB__AGX17840

SEQ ID NO: 210197 - RNA, 1758 nt, Artificial Sequence; identical to SEQ ID NO: 210005
  derived and/or modified sequence opt5 from hemagglutinin__InfluenzaB__AGX17851

SEQ ID NO: 210198 - RNA, 1758 nt, Artificial Sequence
  derived and/or modified sequence opt5 from hemagglutinin__InfluenzaB__AGX17862
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaagcuguauggggauuccaagccccagaaauuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaacacuuccucugauuggcgaagcugacugucuccaugagaaauauggcgggcugaacaaguccaagcccuacuacaccggagagcacgccaaagcgaucggcaauugccccaucugggugaagacaccucugaaacucgccaacgggacgaaguaucgcccgcccgcuaaacugcuuaaggaaagaggauuuuucggcgccauugcuggguuucuggagggcggaugggaaggcaugaucgccggguggcauggauacaccucucacggcgcccacggggucgcuguggcggccgaucucaagagcacacaggaggcuauuaauaaaaucaccaagaaccuuaauucccuuagcgaacuggagguuaaaaaccuccagcggcugucuggagccauggacgagcugcauaaugaaauucucgagcuggaugaaaagguggacgaccuucgcgccgauacaaucuccagccaaaucgagcuggcuguccuccugucuaacgaaggcauuaucaauagcgaggacgagcaccuucuggcccucgaaagaaaacugaagaagaugcuggggccuuccgcgguggagauuggcaacggauguuucgaaaccaaacauaagugcaaucagacgugccucgaucggaucgcugccggcaccuuugacgccggggaguucucucugcccacauuugauagccuuaacauuaccgcugccucccugaaugacgauggacucgacaaccacacaauccugcuguauuacagcaccgcugccucuucccuugcggucacgcucaugauugccaucuucgugguuuauauggugagccgcgauaacgucucuuguuccaucugccuguga

SEQ ID NO: 210199 - RNA, 1758 nt, Artificial Sequence
  derived and/or modified sequence opt5 from hemagglutinin__InfluenzaB__AGX17873
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucgauuguacagaccuggauguggcucuuggacgcccuaagugcaccggcaacauucccucugccagagucagcauccugcacgaggugcggccuguuacauccggguguuuucccaucaugcaugaccgcaccaagauuagacaacucccuaaucugcugcggggauacgaacacauccgccucucuacgcauaacgugauuaaugccgagaacgcuccgggcggccccuauaaaaucgggacaagcggauccugcccuaaugucaccaacggcaauggguucuuugccacaauggcuugggccgugcccaagaacgauaauaacaaaaccgcgaccaauagccugacaauugaagugccuuacaucuguacggagggagaggaccagauuaccgucuggggcuuccacucugauaacgaaacacagauggccaaacuuuauggggacuccaagccccagaaguuuaccagcucugcuaacggaguuacaacccacuacgugucccaaaucggcggcuucccgaaucagacggaggaugggggacugccucagagcggcagaaucguggucgacuauauggugcagaagucugggaaaacaggaaccauuaccuaccaacggggcauccuccugccccagaagguuuggugcgccuccgggcgcagcaaagugauuaagggaucccuuccucugaucggcgaagcugauugucuccaugagaaauauggcgggcugaacaagucuaaacccuacuacacaggagagcacgccaaggcgauuggcaauugccccaucugggucaagaccccucugaaacucgccaacgggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaccucaaauccacccaggaggcuaucaauaagauuacaaagaaccugaauagccuuucugaacuggaggugaaaaaccuccagcgccuguccggagccauggaugagcugcauaaugaaauccucgagcuggacgaaaaggucgacgaucuuagagccgacaccauuagcucucaaaucgagcuggcugugcuccugagcaacgaaggcaucauuaauuccgaggaugagcaccuucuggcccucgaacggaaacugaagaaaaugcuggggccuucugcggucgagaucggcaacggauguuucgaaacaaagcauaagugcaaucagaccugccucgaccgcauugcugccggcacguuugaugccggggaguucagccugcccaccuuugacucccuuaacaucacagcugccagccugaaugaugacggacucgauaaccacaccauucugcuguauuacucuacagcugccuccagccuugcggugacccucaugaucgccauuuucguuguguauauggucucuagagacaacguguccuguagcaucugccuguga

SEQ ID NO: 210200 - RNA, 1758 nt, Artificial Sequence; identical to SEQ ID NO: 209662
  derived and/or modified sequence opt5 from hemagglutinin__InfluenzaB__AGX17884

SEQ ID NO: 210201 - RNA, 1758 nt, Artificial Sequence
  derived and/or modified sequence opt5 from hemagglutinin__InfluenzaB__AGX17895
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaaaucagauggccaaacuuuauggggauuccaagccccagaaguuuacaagcucugcuaacggaguuaccacacacuacgugucccaaaucggcggcuucccgaaucagaccgaggacgggggacugccucagagcggcagaaucguggucgauuauauggugcagaagucugggaaaacgggaacaauuaccuaccaacggggcauccuccugccccagaagguuuggugcgccuccgggcgcagcaaagugauuaagggaucccuuccucugaucggcgaagcugacugucuccaugagaaauauggcgggcugaacaagucuaaacccuacuacaccggagagcacgccaaggcgauuggcaauugccccaucugggucaagacaccucugaaacucgccaacgggaccaaguauagaccgcccgcuaaacugcuuaaggaacggggauuuuucggcgccaucgcuggguuucuggagggcggaugggaaggcaugauugccggguggcauggauacacaagccacggcgcccacgggguggcuguugcggccgaucucaaauccacgcaggaggcuaucaauaagauuaccaagaaccugaauagccuuucugaacuggaggugaaaaaccuccagcgccuguccggagccauggacgagcugcauaaugaaauccucgagcuggaugaaaaggucgacgaccuuagagccgauacaauuagcucucaaaucgagcuggcugugcuccugagcaacgaaggcaucauuaauuccgaggacgagcaccuucuggcccucgaacggaaacugaagaaaaugcuggggccuucugcggucgagaucggcaacggauguuucgaaaccaagcauaagugcaaucagacaugccucgaucgcauugcugccggcaccuuugacgccggggaguucagccugcccacguuugauucccuuaacaucaccgcugccagccugaacgacgauggacucgacaaucacacaauucugcuguauuacucuaccgcugccuccagccuugcggugacacucaugaucgccauuuucguuguguauauggucucuagagauaacguguccuguagcaucugccuguga

SEQ ID NO: 210202 - RNA, 1758 nt, Artificial Sequence; identical to SEQ ID NO: 209662
  derived and/or modified sequence opt5 from hemagglutinin__InfluenzaB__AGX17906

SEQ ID NO: 210203 - RNA, 1758 nt, Artificial Sequence; identical to SEQ ID NO: 209662
  derived and/or modified sequence opt5 from hemagglutinin__InfluenzaB__AGX17917

SEQ ID NO: 210204 - RNA, 1758 nt, Artificial Sequence
  derived and/or modified sequence opt5 from hemagglutinin__InfluenzaB__AGX17928
augaagaccaucauugugcugcucauggucguuacaagcaacgccgacagaaucugcacgggcauuaccuccucuaauagcccccacguggugaaaacagcuacccagggggaggucaacgugacaggaguuaucccucugaccacaaccccgacgaagucccauuucgccaaucuuaaaggcaccaagacacgggggaaacugugucccaagugccucaacuguaccgaucuggacguggcgcuuggacgcccuaagugcacaggcaauauucccucugcugaagucagcauccugcacgaggugagaccuguuaccuccggguguuuucccaucaugcaugaucggacgaaaauucgccaacucccuaaccugcugagaggauacgaacacauccggcucucuacacauaaugugauuaacgccgagaaggccccgggcggccccuauaaaaucgggaccagcggauccugcccuaaugucacaaacggcaauggguucuuugcuaccauggccugggcugugcccaagaacgacaauaacaaaaccgccacaaauagccugacgauugaagugccuuacaucuguaccgagggagaggaucagauuacaaucuggggcuuccacucugacaacgaaacccagauggcgaagcuguauggggauuccaagccccagaaauuuacaagcucugccaacggagucaccacgcacuacguuucccaaaucggcggcuucccgaaucagacagaggacgggggacugccucagagcggccgcauugugguggauuauaugguccagaagucugggaaaaccggaaccaucacauaccaaagaggcauucuccugccccagaagguguggugcgcuuccgggcggagcaaaguuaucaagggaacccuuccucugauuggcgaagccgacugucuccaugagaaauauggcgggcugaacaaguccaagcccuacuacacaggagagcacgcuaaagccaucggcaauugccccaucugggugaagacgccucugaaacucgcgaacgggaccaaguaucgcccgcccgccaaacugcuuaaggaaagaggauuuuucggcgcuauugccggguuucuggagggcggaugggaaggcaugaucgcuggguggcauggauacacaucucacggcgcccacggggucgccguggcugcggaucucaagagcacccaggaggccauuaauaaaaucacaaagaaccuuaauucccuuagcgaacuggagguuaaaaaccuccagcggcugucuggagcuauggacgagcugcauaaugaaauucucgagcuggaugaaaagguggacgaccuucgcgccgauaccaucuccagccaaaucgagcuggccguccuccugucuaacgaaggcauuaucaauagcgaggacgagcaccuucuggcucucgaaagaaaacugaagaagaugcuggggccuuccgccguggagauuggcaacggauguuucgaaacgaaacauaagugcaaucagaccugccucgaucggaucgcggcuggcacauuugacgccggggaguucucucugcccaccuuugauagccuuaacauuacagccgcuucccugaaugacgauggacucgacaaccacaccauccugcuguauuacagcacggccgcuucuucccuugccgucacacucaugauugcgaucuucgugguuuauauggugagccgcgauaacgucucuuguuccaucugccuguga

SEQ ID NO: 210205 - RNA, 1758 nt, Artificial Sequence; identical to SEQ ID NO: 209538
  derived and/or modified sequence opt5 from hemagglutinin__InfluenzaB__AGX17939

SEQ ID NO: 210206 - RNA, 1758 nt, Artificial Sequence; identical to SEQ ID NO: 209538
  derived and/or modified sequence opt5 from hemagglutinin__InfluenzaB__AGX17950

SEQ ID NO: 210207 - RNA, 1758 nt, Artificial Sequence; identical to SEQ ID NO: 209538
  derived and/or modified sequence opt5 from hemagglutinin__InfluenzaB__AGX17961

SEQ ID NO: 210208 - RNA, 1758 nt, Artificial Sequence; identical to SEQ ID NO: 210005
  derived and/or modified sequence opt5 from hemagglutinin__InfluenzaB__AGX17972

SEQ ID NO: 210209 - RNA, 1758 nt, Artificial Sequence; identical to SEQ ID NO: 209538
  derived and/or modified sequence opt5 from hemagglutinin__InfluenzaB__AGX17983

SEQ ID NO: 210210 - RNA, 1758 nt, Artificial Sequence; identical to SEQ ID NO: 209662
  derived and/or modified sequence opt5 from hemagglutinin__InfluenzaB__AGX17994

SEQ ID NO: 210211 - RNA, 1758 nt, Artificial Sequence
  derived and/or modified sequence opt5 from hemagglutinin__InfluenzaB__AGX18005
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaagcuguauggggauuccaaaccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgauaucaaauccacccaggaggcuauuaacaagaucacaaagaaucucaacagccugucugaacuugaggugaaaaaucugcagcgccucuccggagccauggacgagcugcauaacgaaauucuggagcucgaugaaaaggucgacgaccugagagccgauaccaucagcucucaaaucgagcuugcugugcugcucagcaaugaaggcauuaucaacuccgaggacgagcaccuucuugcccuggaacggaaacucaagaaaaugcuggggccuucugcggucgagauuggcaauggauguuucgaaacaaagcauaagugcaaccagaccugccuggaucgcaucgcugccggcacguuugacgccggggaguucagccuccccaccuuugauucccugaauauuacagcugccagccuuaacgacgauggacuggacaaccacaccauccuccuguauuacucuacagcugccuccagccuggcggugacccuuaugauugccaucuucguuguguauauggucucuagagauaauguguccuguagcaucugccucuga

SEQ ID NO: 210212 - RNA, 1758 nt, Artificial Sequence
  derived and/or modified sequence opt5 from hemagglutinin__InfluenzaB__AGX18016
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguauugagggagaggaucagaucacggucuggggcuuccacucugacaacgaaacccagauggccaaacuuuauggggauuccaagccccagaaguuuacaagcucugcuaauggaguuaccacacacuacgugucccaaaucggcggcuucccgaaccagaccgaggacgggggacugccucagagcggcagaauuguggucgauuauauggugcagaagucugggaaaacgggaacaaucaccuaccaacggggcauucuccugccccagaagguuuggugcgccuccgggcgcagcaaagugaucaagggaucccuuccucugauuggcgaagcugacugucuccaugagaaauauggcgggcugaauaagucuaaacccuacuacaccggagagcacgccaaggcgaucggcaacugccccaucugggucaagacaccucugaaacucgccaaugggaccaaguauagaccgcccgcuaaacugcuuaaggaacggggauuuuucggcgccauugcuggguuucuggagggcggaugggaaggcaugaucgccggguggcauggauacacaagccacggcgcccacgggguggcuguugcggccgaucucaaauccacgcaggaggcuauuaacaagaucaccaagaaucugaacagccuuucugaacuggaggugaaaaaucuccagcgccuguccggagccauggacgagcugcauaacgaaauucucgagcuggaugaaaaggucgacgaccuuagagccgauacaaucagcucucaaaucgagcuggcugugcuccugagcaaugaaggcauuaucaacuccgaggacgagcaccuucuggcccucgaacggaaacugaagaaaaugcuggggccuucugcggucgagauuggcaauggauguuucgaaaccaagcauaagugcaaccagacaugccucgaucgcaucgcugccggcaccuuugacgccggggaguucagccugcccacguuugauucccuuaauauuaccgcugccagccugaacgacgauggacucgacaaccacacaauccugcuguauuacucuaccgcugccuccagccuugcggugacacucaugauugccaucuucguuguguauauggucucuagagauaauguguccuguagcaucugccuguga

SEQ ID NO: 210213 - RNA, 1758 nt, Artificial Sequence; identical to SEQ ID NO: 210176
  derived and/or modified sequence opt5 from hemagglutinin__InfluenzaB__AGX18027

SEQ ID NO: 210214 - RNA, 1758 nt, Artificial Sequence; identical to SEQ ID NO: 209662
  derived and/or modified sequence opt5 from hemagglutinin__InfluenzaB__AGX18038

SEQ ID NO: 210215 - RNA, 1758 nt, Artificial Sequence; identical to SEQ ID NO: 209662
  derived and/or modified sequence opt5 from hemagglutinin__InfluenzaB__AGX18049

SEQ ID NO: 210216 - RNA, 1758 nt, Artificial Sequence; identical to SEQ ID NO: 209662
  derived and/or modified sequence opt5 from hemagglutinin__InfluenzaB__AGX18060

SEQ ID NO: 210217 - RNA, 1758 nt, Artificial Sequence; identical to SEQ ID NO: 209538
  derived and/or modified sequence opt5 from hemagglutinin__InfluenzaB__AGX18071

SEQ ID NO: 210218 - RNA, 1758 nt, Artificial Sequence; identical to SEQ ID NO: 210198
  derived and/or modified sequence opt5 from hemagglutinin__InfluenzaB__AGX18082

SEQ ID NO: 210219 - RNA, 1758 nt, Artificial Sequence; identical to SEQ ID NO: 210198
  derived and/or modified sequence opt5 from hemagglutinin__InfluenzaB__AGX18093

SEQ ID NO: 210220 - RNA, 1758 nt, Artificial Sequence; identical to SEQ ID NO: 210005
  derived and/or modified sequence opt5 from hemagglutinin__InfluenzaB__AGX18104

SEQ ID NO: 210221 - RNA, 1758 nt, Artificial Sequence; identical to SEQ ID NO: 209662
  derived and/or modified sequence opt5 from hemagglutinin__InfluenzaB__AGX18115

SEQ ID NO: 210222 - RNA, 1758 nt, Artificial Sequence; identical to SEQ ID NO: 209662
  derived and/or modified sequence opt5 from hemagglutinin__InfluenzaB__AGX18126

SEQ ID NO: 210223 - RNA, 1758 nt, Artificial Sequence; identical to SEQ ID NO: 209538
  derived and/or modified sequence opt5 from hemagglutinin__InfluenzaB__AGX18137

SEQ ID NO: 210224 - RNA, 1758 nt, Artificial Sequence; identical to SEQ ID NO: 210198
  derived and/or modified sequence opt5 from hemagglutinin__InfluenzaB__AGX18148

SEQ ID NO: 210225 - RNA, 1758 nt, Artificial Sequence; identical to SEQ ID NO: 209538
  derived and/or modified sequence opt5 from hemagglutinin__InfluenzaB__AGX18159

SEQ ID NO: 210226 - RNA, 1758 nt, Artificial Sequence; identical to SEQ ID NO: 209538
  derived and/or modified sequence opt5 from hemagglutinin__InfluenzaB__AGX18170

SEQ ID NO: 210227 - RNA, 1758 nt, Artificial Sequence; identical to SEQ ID NO: 210198
  derived and/or modified sequence opt5 from hemagglutinin__InfluenzaB__AGX18181

SEQ ID NO: 210228 - RNA, 1758 nt, Artificial Sequence
  derived and/or modified sequence opt5 from hemagglutinin__InfluenzaB__AGX18192
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaagcuguauggggauuccaagccccagaaauuuaccagcucuacaaacggagucaccacgcacuacguuucccaaaucggcggcuucccgaaucagacagaggacgggggacugccucagagcggccgcauugugguggauuauaugguccagaagcccgggaaaaccggaaccaucacauaccaaagaggcauucuccugccucagaagguguggugcgcuucugggcgguccaaaguuaucaagggaagccuuccccugauuggcgaagccgacugucuccaugagaaauauggcgggcugaacaaguccaagcccuacuacaccggagagcacgcuaaagccaucggcaauugcccuaucugggugaagacaccgcugaaacucgcgaacgggacgaaguauagacccccugccaaacugcuuaaggaacgcggauuuuucggcgcuauugccggguuucuggagggcggaugggaaggcaugaucgcuggguggcauggauacaccucucacggcgcccacggggucgccguggcugcggaucucaagagcacacaggaggccauuaauaaaaucaccaagaaccuuaauucccuuagcgaacuggagguuaaaaaccuccagcggcugucuuccgcuauggacgagcugcauaaugaaauucucgagcuggaugaaaagguggacgaccuucgcgccgauacaaucagcucucaaaucgagcuggccguccuccugagcaacgaaggaauuaucaauuccgaggacgagcaccuucuggcucucgaaagaaaacugaagaagaugcugggccccucugccguggagauugggaacggcuguuucgaaaccaaacauaagugcaaucagacgugccucgaucggaucgcggcuggaaccuuugacgccggcgaguucagccugccuacauuugauucccuuaacauuaccgccgcuagccugaaugacgaugggcucgacaaccacacaauccugcuguauuacucuaccgccgcuuccagccuugccgucacgcucaugauugcgaucuucgugguuuauauggugucucgcgauaacgucuccuguagcaucugccuguga

SEQ ID NO: 210229 - RNA, 1758 nt, Artificial Sequence; identical to SEQ ID NO: 210176
  derived and/or modified sequence opt5 from hemagglutinin__InfluenzaB__AGX18203

SEQ ID NO: 210230 - RNA, 1758 nt, Artificial Sequence
  derived and/or modified sequence opt5 from hemagglutinin__InfluenzaB__AGX18214
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaacagggaccagcggauccugcccuaaugucacaaacggcaauggguucuuugccaccauggcuugggccgugcccaagaacgacaauaacaaaaccgcgacaaauagccugacgaucgaagugccuuacauuuguaccgagggagaggaucagaucacaauuuggggcuuccacucugacaacgaaacccagauggccaaacuuuauggggauuccaagccccagaaguuuacaagcucugcuaacggagucaccacgcacuacguuucccaaaucggcggcuucccgaaucagacagaggacgggggacugccucagagcggccgcaucgugguggauuauaugguccagaagucugggaaaaccggaaccauuacauaccaaagaggcauccuccugccccagaagguguggugcgccuccgggcggagcaaaguuauuaagggaucccuuccucugaucggcgaagcugacugucuccaugagaaauauggcgggcugaacaagucuaagcccuacuacaccggagagcacgccaaagcgauuggcaauugccccaucugggugaagacaccucugaaacucgccaacgggacgaaguaucgcccgcccgcuaaacugcuuaaggaaagaggauuuuucggcgccaucgcuggguuucuggagggcggaugggaaggcaugauugccggguggcauggauacaccagccacggcgcccacggggucgcuguggcggccgaucucaaguccacacaggaggcuaucaauaaaauuaccaagaaccugaauagccuuucugaacuggagguuaaaaaccuccagcggcuguccggagccauggacgagcugcauaaugaaauccucgagcuggaugaaaagguggacgaccuucgcgccgauacaauuagcucucaaaucgagcuggcuguccuccugagcaacgaaggcaucauuaauuccgaggacgagcaccuucuggcccucgaaagaaaacugaagaagaugcuggggccuucugcgguggagaucggcaacggauguuucgaaaccaaacauaagugcaaucagacgugccucgaucggauugcugccggcaccuuugacgccggggaguucagccugcccacauuugauucccuuaacaucaccgcugccagccugaaugacgauggacucgacaaccacauuauccugcuguauuacucuacagcugccuccagccuugcggucacccucaugauugccaucuucgugguuuauauggugucucgcgauaacgucuccuguagcaucugccuguga

SEQ ID NO: 210231 - RNA, 1758 nt, Artificial Sequence
  derived and/or modified sequence opt5 from hemagglutinin__InfluenzaB__AGX18225
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaauuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaaucggaucacaaagaaccugaauagccuuucugaacuggagguuaagaaccuccagcgccuguccggagccauggacgagcugcauaaugaaauucucgagcuggaugaaaaaguggacgaccuuagagccgauaccaucagcucucaaaucgagcuggcuguccuccugagcaacgaaggcauuaucaauuccgaggacgagcaccuucuggcccucgaacggaagcugaaaaagaugcuggggccuucugcgguggagauuggcaacggauguuucgaaacaaagcauaaaugcaaucagaccugccucgaucgcaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauugccaucuucgugguuuauauggugucuagagauaacgucuccuguagcaucugccuguga

SEQ ID NO: 210232 - RNA, 1758 nt, Artificial Sequence
  derived and/or modified sequence opt5 from hemagglutinin__InfluenzaB__AGX18236
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugaugcagaagucugggaaaacaggaaccaucaccuaccaaagaggcauucuccugccccagaaggucuggugcgccuccgggcggagcaaagugaucaagggaucccuuccucugauuggcgaagcugacugucuccaugagaaauauggcgggcugaacaagucuaagcccuacuacacaggagagcacgccaaagcgaucggcaauugccccaucuggguuaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacgggguggcugucgcggccgaucucaaguccacccaggaggcuauuaauaaaaucacaaagaaccugaauagccuuucugaacuggaggugaaaaaccuccagcggcuguccggagccauggacgagcugcauaaugaaauucucgagcuggaugaaaagguugacgaccuucgcgccgauaccaucagcucucaaaucgagcuggcugugcuccugagcaacgaaggcauuaucaauuccgaggacgagcaccuucuggcccucgaaagaaaacugaagaagaugcuggggccuucugcggucgagauuggcaacggauguuucgaaacaaaacauaagugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggugacccucaugauugccaucuucgucguguauaugguuucucgcgauaacguguccuguagcaucugccuguga

SEQ ID NO: 210233 - RNA, 1758 nt, Artificial Sequence; identical to SEQ ID NO: 209589
  derived and/or modified sequence opt5 from hemagglutinin__InfluenzaB__AGX18247

SEQ ID NO: 210234 - RNA, 1758 nt, Artificial Sequence
  derived and/or modified sequence opt5 from hemagglutinin__InfluenzaB__AGX18258
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaaaaauaagaccgcgaccaacagccugacaauugaagugccuuacaucuguacggagggagaggaucagauuaccaucuggggcuuccacucugacaaugaaacacagauggccaaacuuuauggggauuccaagccccagaaguuuaccagcucugcuaacggagucacaacccacuacguuucccaaaucggcggcuucccgaaccagacggaggacgggggacugccucagagcggccgcauugugguggauuauaugguccagaaaucugggaagacaggaaccaucaccuaccaaagaggcauucuccugccccagaaaguguggugcgccuccgggcggagcaagguuaucaaaggaacacuuccucugauuggcgaagcugacugucuccaugagaaguauggcgggcugaauaaguccaaacccuacuacaccggagagcacgccaaggcgaucggcaacugccccaucugggugaaaacaccucugaagcucgccaaugggacgaaauaucgcccgcccgcuaagcugcuuaaggaaagaggauuuuucggcgccauugcuggguuucuggagggcggaugggaaggcaugaucgccggguggcauggauacaccucucacggcgcccacggggucgcuguggcggccgaucucaaaagcacacaggaggcuauuaacaagaucaccaaaaaucugaacucccuuagcgaacuggagguuaagaaucuccagcggcugucuggagccauggacgagcugcauaacgaaauucucgagcuggaugaaaaaguggacgaccuucgcgccgauacaaucuccagccaaaucgagcuggcuguccuccugucuaaugaaggcauuaucaacagcgaggacgagcaccuucuggcccucgaaagaaagcugaagaaaaugcuggggccuuccgcgguggagauuggcaauggauguuucgaaaccaagcauaaaugcaaccagacgugccucgaucggaucgcugccggcaccuuugacgccggggaguucucucugcccacauuugauagccuuaauauuaccgcugccucccugaacgacgauggacucgacaaucacacaauccugcuguauuacagcaccgcugccucuucccuugcggucacgcucaugauugccaucuucgugguuuauauggugagccgcgauaacgucucuuguuccaucugccuguga

SEQ ID NO: 210235 - RNA, 1758 nt, Artificial Sequence; identical to SEQ ID NO: 209538
  derived and/or modified sequence opt5 from hemagglutinin__InfluenzaB__AGX18280

SEQ ID NO: 210236 - RNA, 1758 nt, Artificial Sequence
  derived and/or modified sequence opt5 from hemagglutinin__InfluenzaB__AGX18291
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcguuuccgggcggagcaaagugaucaagggaucccuuccucugauuggcgaagccgacugucuccaugagaaauauggcgggcugaacaagucuaagcccuacuacacaggagagcacgcuaaagccaucggcaauugccccaucugggucaagaccccucugaaacucgcgaacgggacaaaguaucgcccgcccgccaaacugcuuaaggaaagaggauuuuucggcgcuauugccggguuucuggagggcggaugggaaggcaugaucgcuggguggcauggauacacgagccacggcgcccacgggguggccguugcugcggaucucaaguccacccaggaggccauuaauaaaaucacaaagaaccugaauagccuuucugaacuggaggugaaaaaccuccagcggcuguccggagcuauggacgagcugcauaaugaaauucucgagcuggaugaaaaggucgacgaccuucgcgccgauaccaucagcucucaaaucgagcuggccgugcuccugagcaacgaaggcauuaucaauuccgaggacgagcaccuucuggcucucgaaagaaaacugaagaagaugcuggggccuucugccgucgagauuggcaacggauguuucgaaacaaaacauaagugcaaucagaccugccucgaucggaucgcggcuggcacguuugacgccggggaguucagccugcccaccuuugauucccuuaacauuacagccgcuagccugaaugacgauggacucgacaaccacaccauccugcuguauuacucuacagccgcuuccagccuugccgugacccucaugauugcgaucuucguuguguauauggucucucgcgauaacguguccuguagcaucugccuguga

SEQ ID NO: 210237 - RNA, 1758 nt, Artificial Sequence
  derived and/or modified sequence opt5 from hemagglutinin__InfluenzaB__AGX18302
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacaagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccaucuggggcuuccacucugacaacgagacacagauggccaagcuguauggggauuccaaaccccagaaguuuaccagcucugcuaacggagucacaacccacuacguuucccaaaucggcggcuucccgaaucagacggaagacgggggacugccucagagcggccgcauugugguggauuauaugguccagaaaucugggaagacaggaaccaucaccuaccaaagaggcauucuccugccccagaaaguguggugcgccuccgggcggagcaagguuaucaaaggaacacuuccucugauuggcgaggcugacugucuccaugaaaaguauggcgggcugaacaaguccaaacccuacuacaccggagagcacgccaaggcgaucggcaauugccccaucugggugaaaacaccucugaagcucgccaacgggacgaaauaucgcccgcccgcuaagcugcuuaaggagagaggauuuuucggcgccauugcuggguuucuggaaggcggaugggagggcaugaucgccggguggcauggauacaccucucacggcgcccacggggucgcuguggcggccgaucucaaaagcacacaggaagcuauuaauaagaucaccaaaaaccuuaauucccuuagcgagcuggaaguuaagaaccuccagcggcugucuggagccauggacgagcugcauaaugagauucucgaacuggaugagaaaguggacgaccuucgcgccgauacaaucuccagccaaaucgaacuggcuguccuccugucuaacgagggcauuaucaauagcgaagacgagcaccuucuggcccucgagagaaagcugaagaaaaugcuggggccuuccgcgguggaaauuggcaacggauguuucgagaccaagcauaaaugcaaucagacgugccucgaucggaucgcugccggcaccuuugacgccggggaguucucucugcccacauuugauagccuuaacauuaccgcugccucccugaaugacgauggacucgacaaccacacaauccugcuguauuacagcaccgcugccucuucccuugcggucacgcucaugauugccaucuucgugguuuauauggugagccgcgauaacgucucuuguuccaucugccuguga

SEQ ID NO: 210238 - RNA, 1758 nt, Artificial Sequence; identical to SEQ ID NO: 209538
  derived and/or modified sequence opt5 from hemagglutinin__InfluenzaB__AGX18313

SEQ ID NO: 210239 - RNA, 1758 nt, Artificial Sequence
  derived and/or modified sequence opt5 from hemagglutinin__InfluenzaB__AGX18324
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaagcccagauggcuaaacuuuauggggauuccaagccccagaaguuuacaagcucugccaacggagucaccacacacuacguuucccaaaucggcggcuucccgaaucagaccgaggacgggggacugccucagagcggccgcauugugguggauuauaugguccagaagucugggaaaacgggaacaaucaccuaccaaagaggcauucuccugccccagaagguguggugcgcuuccgggcggagcaaaguuaucaagggaucccuuccucugauuggcgaagccgacugucuccaugagaaauauggcgggcugaacaagucuaagcccuacuacaccggagagcacgcgaaagccaucggcaauugccccaucugggugaagacaccucugaaacucgcuaacgggaccaaguaucgcccgcccgccaaacugcuuaaggaaagaggauuuuucggcgcuauugccggguuucuggagggcggaugggaaggcaugaucgccggguggcauggauacacaagccacggcgcucacggggucgcgguggccgcugaucucaaguccacgcaggaggccauuaauaaaaucaccaagaaccugaauagccuuucugaacuggagguuaaaaaccuccagcggcuguccggagccauggacgagcugcauaaugaaauucucgagcuggaugaaaagguggacgaccuucgcgcugauacaaucagcucucaaaucgagcuggccguccuccugagcaacgaaggcauuaucaauuccgaggacgagcaccuucuggcgcucgaaagaaaacugaagaagaugcuggggccuucugcuguggagauuggcaacggauguuucgaaaccaaacauaagugcaaucagacaugccucgaucggaucgccgccggcaccuuugacgcuggggaguucagccugcccacguuugauucccuuaacauuaccgccgcuagccugaaugacgauggacucgacaaccacacaauccugcuguauuacucuaccgccgcguccagccuugccgucacacucaugauugcuaucuucgugguuuauauggugucucgcgauaacgucuccuguagcaucugccuguga

SEQ ID NO: 210240 - RNA, 1758 nt, Artificial Sequence; identical to SEQ ID NO: 210198
  derived and/or modified sequence opt5 from hemagglutinin__InfluenzaB__AGX18335

SEQ ID NO: 210241 - RNA, 1758 nt, Artificial Sequence
  derived and/or modified sequence opt5 from hemagglutinin__InfluenzaB__AGX18346
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcggcuguccggagccauggacgagcugcauaaugaaauucucgagcuggaugaaaagguggacgaccuucgcgccgauaccaucagcucucaaaucgagcuggcuguccuccugagcaacgaaggcauuaucaauuccgaggacgagcaccuucuggcccucgaaagaaaacugaagaagaugcuggggccuucugcgguggagauuggcaacggauguuucgaaacaaaacauaagugcaaucagaccugccucgaucggaucgcugccggcacguuugacgccggggaguucagccugcccaccuuugauucccuuaacauuacagcugccagccugaaugaagacggacucgauaaccacaccauccugcuguauuacucuacagcugccuccagccuugcggucacccucaugauugccaucuucgugguuuauauggugucucgcgacaacgucuccuguagcaucugccuguga

SEQ ID NO: 210242 - RNA, 1758 nt, Artificial Sequence
  derived and/or modified sequence opt5 from hemagglutinin__InfluenzaB__AGX18357
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccgcgccgacaaagucccauuucgcuaaucuuaaaggcaccaagacgcgggggaaacugugucccaagugccucaacuguaccgaucuggacguggcccuuggacgcccuaagugcacaggcaauauucccucugccgaagucagcauccugcacgaggugagaccuguuaccuccggguguuuucccaucaugcaugaucggacaaaaauucgccaacucccuaaccugcugagaggauacgaacacauccggcucucuacccauaaugugauuaacgcugagaaggccccgggcggccccuauaaaaucgggacgagcggauccugcccuaaugucacaaacggcaauggguucuuugcuaccauggccugggcggugcccaagaacgacaauaacaaaacagccaccaauagccugaccauugaagugccuuacaucuguacagagggagaggaucagauuacgaucuggggcuuccacucugacaaggaaacccagauggcuaaacuuuauggggauuccaagccccagaaguuuacaagcucugccaacggagucaccacacacuacguuucccaaaucggcggcuucccgaaccagaccgaggacgggggacugccucagagcggccgcauugugguggauuauaugguccagaaacccgggaagacgggaacaaucaccuaccaaagaggcauucuccugccucagaaaguguggugcgcuucugggcgguccaagguuaucaaaggaagccuuccccugauuggcgaagccgacugucuccaugagaaguauggcgggcugaauaaguccaaacccuacuacaccggagagcacgcgaaggccaucggcaacugcccuaucugggugaaaacaccgcugaagcucgcuaaugggaccaaauauagacccccugccaagcugcuuaaggaacgcggauuuuucggcgcuauugccggguuucuggagggcggaugggaaggcaugaucgccggguggcauggauacacaucucacggcgcucacggggucgcgguggccgcugaucucaaaagcacgcaggaggccauuaacaagaucaccaaaaaucugaacucccuuagcgaacuggagguuaagaaucuccagcggcugucuuccgccauggacgagcugcauaacgaaauucucgagcuggaugaaaaaguggacgaccuucgcgcugauacaaucagcucucaaaucgagcuggccguccuccugagcaaugaaggaauuaucaacuccgaggacgagcaccuucuggcgcucgaaagaaagcugaagaaaaugcugggccccucugcuguggagauugggaauggcuguuucgaaaccaagcauaaaugcaaccagacaugccucgaucggaucgccgccggaaccuuugacgcuggcgaguucagccugccuacguuugauucccuuaauauuaccgccgcuagccugaacgacgaugggcucgacaaucacacaauccugcuguauuacucuaccgccgcguccagccuugccgucacacucaugauugcuaucuucgugguuuauauggugucucgcgauaacgucuccuguagcaucugccuguga

SEQ ID NO: 210243 - RNA, 1758 nt, Artificial Sequence
  derived and/or modified sequence opt5 from hemagglutinin__InfluenzaB__AGX18368
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccgcgccgacaaagucccauuucgcuaaucuuaaaggcaccaagacgcgggggaaacugugucccaagugccucaacuguaccgaucuggacguggcccuuggacgcccuaagugcacaggcaauacccccucugccgaagucagcauucugcacgaggugagaccuguuacauccggguguuuucccaucaugcaugaucggaccaaaauccgccaacucccuaaccugcugagaggauacgaacacauucggcucucuaaucauaacgugaucaaugcugagaaggccccgggcggccccuauaaaauugggacgagcggauccugcccuaacgucacaaauggcaacggguucuuugcuaccauggccugggcggugcccaagaaugacaacaauaaaacagccaccaacagccugaccaucgaagugccuuacauuuguacagagggagaggaucagaucacgauuuggggcuuccacucugacaacgaaacccagauggcuaaacuuuauggggauuccaagccccagaaguuuacaagcucugccaauggagucaccacacacuacguuucccaaaucggcggcuucccgaaccagaccgaggacgggggacugccucagagcggccgcaucgugguggauuauaugguccagaagcccgggaaaacgggaacaauuaccuaccaaagaggcauccuccugccucagaagguguggugcgcuucugggcgguccaaaguuauuaagggaagccuuccccugaucggcgaagccgacugucuccaugagaaauauggcgggcugaauaaguccaagcccuacuacaccggagagcacgcgaaagccauuggcaacugcccuaucugggugaagacaccgcugaaacucgcuaaugggaccaaguauagacccccugccaaacugcuuaaggaacgcggauuuuucggcgcuaucgccggguuucuggagggcggaugggaaggcaugauugccggguggcauggauacacaucucacggcgcucacggggucgcgguggccgcugaucucaagagcacgcaggaggccaucaacaaaauuaccaagaaucugaacucccuuagcgaacuggagguuaaaaaucuccagcggcugucuuccgccauggacgagcugcauaacgaaauccucgagcuggaugaaaagguggacgaccuucgcgcugauacaauuagcucucaaaucgagcuggccguccuccugagcaaugaaggaaucauuaacuccgaggacgagcaccuucuggcgcucgaaagaaaacugaagaagaugcugggccccucugcuguggagaucgggaauggcuguuucgaaaccaaacauaagugcaaccagacaugccucgaucggauugccgccggaaccuuugacgcuggcgaguucagccugccuacguuugauucccuuaauaucaccgccgcuagccugaacgacgaugggcucgacaaccacacaauucugcuguauuacucuaccgccgcguccagccuugccgucacacucaugaucgcuauuuucgugguuuauauggugucucgcgauaaugucuccuguagcaucugccuguga

SEQ ID NO: 210244 - RNA, 1758 nt, Artificial Sequence; identical to SEQ ID NO: 209662
  derived and/or modified sequence opt5 from hemagglutinin__InfluenzaB__AGX18379

SEQ ID NO: 210245 - RNA, 1758 nt, Artificial Sequence; identical to SEQ ID NO: 210198
  derived and/or modified sequence opt5 from hemagglutinin__InfluenzaB__AGX18390

SEQ ID NO: 210246 - RNA, 1758 nt, Artificial Sequence
  derived and/or modified sequence opt5 from hemagglutinin__InfluenzaB__AGX18401
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccgcgccgacaaagucccauuucgcuaaucuuaaaggcaccaagacgcgggggaaacugugucccaagugccucaacuguaccgaucuggacguggcccuuggacgcccuaagugcacaggcaauauucccucugccgaagucagcauccugcacgaggugagaccuguuaccuccggguguuuucccaucaugcaugaucggacaaaaauucgccaacucccuaaccugcugagaggauacgaacacauccggcucucuacccauaaugugauuaacgcugagaaggccccgggcggccccuauaaaaucgggacgagcggauccugcccuaaugucacaaacggcaauggguucuuugcuaccauggccugggcggugcccaagaacgacaauaacaaaacagccaccaauagccugaccauugaagugccuuacaucuguacagagggagaggaucagauuacgaucuggggcuuccacucugacaacgaaauccagauggcuaagcuguauggggauuccaagccccagaaauuuaccagcucugccaacggagucacaacccacuacguuucccaaauuggcggcuucccgaaucagacagaggacgggggacugccucagagcggccgcaucgugguggauuauaugguccagaagcccgggaaaaccggaacgauuacauaccaaagaggcauccuccugccucagaagguguggugcgcuucugggcgguccaaaguuauuaagggaagccuuccccugaucggcgaagccgacugucuccaugagaaauauggcgggcugaacaaguccaagcccuacuacaccggagagcacgcgaaagccaucggcaauugcccuauuugggugaagaccccgcugaaacucgcuaacgggacaaaguauagacccccugccaaacugcuuaaggaacgcggauuuuucggcgcuaucgccggguuucuggagggcggaugggaaggcaugauugccggguggcauggauacaccucucacggcgcucacggggucgcgguggccgcugaucucaagagcacacaggaggccaucaauaaaauuacgaagaaccuuaauucccuuagcgaacuggagguuaaaaaccuccagcggcugucuuccgccauggacgagcugcauaaugaaauccucgagcuggaugaaaagguggacgaccuucgcgcugauaccaucagcucucaaauugagcuggccguccuccugagcaacgaaggaaucauuaauuccgaggacgagcaccuucuggcgcucgaaagaaaacugaagaagaugcugggccccucugcuguggagaucgggaacggcuguuucgaaacaaaacauaagugcaaucagaccugccucgaucggauugccgccggaacauuugacgcuggcgaguucagccugccuaccuuugauucccuuaacaucacggccgcuagccugaaugacgaugggcucgacaaccacaccauucugcuguauuacucuacagccgcguccagccuugccgucacccucaugaucgcuaucuucgugguuuauauggugucucgcgauaacgucuccuguagcauuugccuguga

SEQ ID NO: 210247 - RNA, 1758 nt, Artificial Sequence
  derived and/or modified sequence opt5 from hemagglutinin__InfluenzaB__AGX18412
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuaaucauaacgugauuaaugccgagaaggcuccgggcggccccuauaaaaucgggacgagcggauccugcccuaacgucacaaauggcaacggguucuuugccaccauggcuugggccgugcccaagaaugacaacaauaaaacagcgaccaacagccugaccauugaagugccuuacaucuguacagagggagaggaucagauuacgaucuggggcuuccacucugacaacgaagcccagauggcuaaacuuuauggggauuccaagccccagaaguuuaccagcucugccaauggagucacaacccacuacguuucccaaaucggcggcuucccgaaccagacagaggacgggggacugccucagagcggccgcauugugguggauuauaugguccagaagucugggaaaaccggaacgaucacauaccaaagaggcauucuccugccccagaagguguggugcgcuuccgggcggagcaaaguuaucaagggaucccuuccucugauuggcgaagccgacugucuccaugagaaauauggcgggcugaauaagucuaagcccuacuacaccggagagcacgcgaaagccaucggcaacugccccaucugggugaagaccccucugaaacucgcuaaugggacaaaguaucgcccgcccgccaaacugcuuaaggaaagaggauuuuucggcgcuauugccggguuucuggagggcggaugggaaggcaugaucgccggguggcauggauacaccagccacggcgcucacggggucgcgguggccgcugaucucaaguccacacaggaggccauuaacaaaaucacgaagaaucugaacagccuuucugaacuggagguuaaaaaucuccagcggcuguccggagccauggacgagcugcauaacgaaauucucgagcuggaugaaaagguggacgaccuucgcgcugauaccaucagcucucaaaucgagcuggccguccuccugagcaaugaaggcauuaucaacuccgaggacgagcaccuucuggcgcucgaaagaaaacugaagaagaugcuggggccuucugcuguggagauuggcaauggauguuucgaaacaaaacauaagugcaaccagaccugccucgaucggaucgccgccggcacauuugacgcuggggaguucagccugcccaccuuugauucccuuaauauuacggccgcuagccugaacgacgauggacucgacaaccacaccauccugcuguauuacucuacagccgcguccagccuugccgucacccucaugauugcuaucuucgugguuuauauggugucucgcgauaaugucuccuguagcaucugccuguga

SEQ ID NO: 210248 - RNA, 1758 nt, Artificial Sequence; identical to SEQ ID NO: 210005
  derived and/or modified sequence opt5 from hemagglutinin__InfluenzaB__AGX18423

SEQ ID NO: 210249 - RNA, 1755 nt, Artificial Sequence
  derived and/or modified sequence opt5 from hemagglutinin__InfluenzaB__AGX18424
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgauuaagucccauuucgcgaaucuuaaaggcacccggacgcgcgggaagcugugucccgauugccucaacuguaccgaccuggauguggcucuuggaagaccuaugugcgucggcacaacccccucugccaaagccagcauccugcacgaagugcggccuguuacauccggguguuuucccaucaugcaugaccgcaccaagauuagacaacucccuaaucugcugcggggauacgagaacauccgccucucuacgcagaaugugauugaugcugaaaaggcccugggcggcccguauagacuugggacaagcggauccugccccaacgcuaccagcaaaucuggcuucuuugccacaauggcgugggccgucccuaaggacaauaacaaaaaugcuaccaacccccugaccguggaggugccuuacaucuguacagaaggggaggaucagauuacggucuggggauuccacuccgacgauaagacccagaugaaaaaucucuauggcgacagcaacccccaaaaguuuacaucuuccgccaaugggguuaccacacauuacgugagccagaucggaggcuucccggaucagaccgaggacggcgggcugccucagucuggacggauuguggucgauuauauggugcaaaagcccggcaaaacggggacaaucguuuaccagcgcggagugcuucugccucagaaggucuggugcgcuuccggcagaagcaaagugaucaaggggucccucccccugauuggagaagccgacugucugcacgagaaauauggcggccucaacaagucuaaacccuacuacaccggggaacacgcgaaggccaucggaaacugcccuauuuggguuaagaccccgcugaaacuugcuaauggcacaaaguaucggcccccugccaaacugcucaaggagcgcggguuuuucggagcuaucgccggcuuucuggaagggggcugggaaggaaugauugccggcuggcauggguacaccagccacggagcucauggcguggcggucgccgcugaccuuaaauccacacaggaggccaucaacaagaucacgaagaaucugaacagccucucugaacuggaggugaaaaaucugcaaagacucuccggggccauggaugaacugcacaacgagauucuugagcuggacgaaaaggucgaugaccuccgggcugauaccaucagcucucagauugagcuggccgugcuucugagcaaugaaggaaucauuaacuccgaggacgaacaccuccuggcgcuggagcgcaaacucaagaaaaugcugggccccucugcuguugauaucgggaauggcuguuucgagacaaagcauaagugcaaccagaccugccuugacagaaucgccgccggaacauuuaaugcuggcgaguucagccugccuaccuuugauucccucaacauuacggccgcuagccugaaugacgaugggcuggacaaccacaccauccuucucuauuacucuacagccgcguccagccuggccgugacccugaugcucgcuauuuucaucgucuauauggugucucgggacaauguuuccuguagcauuugccuguga

SEQ ID NO: 210250 - RNA, 1758 nt, Artificial Sequence
  derived and/or modified sequence opt5 from hemagglutinin__InfluenzaB__AGX18435
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaauccagauggccaaacuuuauggggauuccaagccccagaaguuuacaagcucugcuaacggagucaccacacacuacguuucccaaauuggcggcuucccgaaucagaccgaggacgggggacugccucagagcggccgcaucgugguggauuauaugguccagaagucugggaaaacgggaacaauuaccuaccaaagaggcauccuccugccccagaagguguggugcgccuccgggcggagcaaaguuauuaagggaucccuuccucugaucggcgaagcugacugucuccaugagaaauauggcgggcugaacaagucuaagcccuacuacaccggagagcacgccaaagcgaucggcaauugccccauuugggugaagacaccucugaaacucgccaacgggaccaaguaucgcccgcccgcuaaacugcuuaaggaaagaggauuuuucggcgccaucgcuggguuucuggagggcggaugggaaggcaugauugccggguggcauggauacacaagccacggcgcccacggggucgcuguggcggccgaucucaaguccacgcaggaggcuaucaauaaaauuaccaagaaccugaauagccuuucugaacuggagguuaaaaaccuccagcggcuguccggagccauggacgagcugcauaaugaaauccucgagcuggaugaaaagguggacgaccuucgcgccgauacaaucagcucucaaauugagcuggcuguccuccugagcaacgaaggcaucauuaauuccgaggacgagcaccuucuggcccucgaaagaaaacugaagaagaugcuggggccuucugcgguggagaucggcaacggauguuucgaaaccaaacauaagugcaaucagacaugccucgaucggauugcugccggcaccuuugacgccggggaguucagccugcccacguuugauucccuuaacaucaccgcugccagccugaaugacgauggacucgacaaccacacaauucugcuguauuacucuaccgcugccuccagccuugcggucacacucaugaucgccaucuucgugguuuauauggugucucgcgauaacgucuccuguagcauuugccuguga

SEQ ID NO: 210251 - RNA, 1758 nt, Artificial Sequence; identical to SEQ ID NO: 209662
  derived and/or modified sequence opt5 from hemagglutinin__InfluenzaB__AGX18446

SEQ ID NO: 210252 - RNA, 1758 nt, Artificial Sequence; identical to SEQ ID NO: 210198
  derived and/or modified sequence opt5 from hemagglutinin__InfluenzaB__AGX18457

SEQ ID NO: 210253 - RNA, 1758 nt, Artificial Sequence; identical to SEQ ID NO: 210005
  derived and/or modified sequence opt5 from hemagglutinin__InfluenzaB__AGX18468

SEQ ID NO: 210254 - RNA, 1758 nt, Artificial Sequence; identical to SEQ ID NO: 210198
  derived and/or modified sequence opt5 from hemagglutinin__InfluenzaB__AGX18479

SEQ ID NO: 210255 - RNA, 1758 nt, Artificial Sequence; identical to SEQ ID NO: 209538
  derived and/or modified sequence opt5 from hemagglutinin__InfluenzaB__AGX18490

SEQ ID NO: 210256 - RNA, 1758 nt, Artificial Sequence
  derived and/or modified sequence opt5 from hemagglutinin__InfluenzaB__AGX18512
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggcgccugugucccaagugccucaacuguacagaucuggacguggcucuuggaagaccuaaaugcaccggcaauauucccucugcccgggucagcauccugcacgaggugcgcccuguuacauccggguguuuucccaucaugcaugauagaaccaagauucggcaacucccuaaccugcugcgcggauacgaacacaucagacucucuacgcauaaugugauuaacgccgagaaugcuccgggcggccccuauaagaucgggacaagcggauccugcccuaacgucaccaauggcaacggguucuuugccacaauggcuugggccgugcccaaaaaugacaacaauaagaccgcgaccaacagccugacaauugaagugccuuacaucuguacggagggagaggaucagauuaccgucuggggcuuccacucugacaacgaaacacagauggccaaacuuuauggggauuccaagccccagaaauuuaccagcucugcuaauggaguuacaacccacuacgugucccaaaucggcggcuucccgaaccagacggaggacgggggacugccucagagcggccggaucguggucgauuauauggugcagaagucugggaagacaggaaccauuaccuaccaacgcggcauccuccugccccagaaaguuuggugcgccuccgggagaagcaaggugauuaaaggaucccuuccucugaucggcgaagcugacugucuccaugagaaguauggcgggcugaauaaaucuaagcccuacuacacaggagagcacgccaaagcgauuggcaacugccccaucugggucaagaccccucugaagcucgccaaugggacaaaauaucggccgcccgcuaagcugcuuaaagaacgcggauuuuucggcgccaucgcuggguuucuggagggcggaugggaaggcaugauugccggguggcauggauacacgagccacggcgcccacgggguggcuguugcggccgaucucaaguccacccaggaggcuaucaacaaaauuacaaagaaucugaacagccuuucugaacuggaggugaagaaucuccagagacuguccggagccauggacgagcugcauaacgaaauccucgagcuggaugaaaaagucgacgaccuucgggccgauaccauuagcucucaaaucgagcuggcugugcuccugagcaaugaaggcaucauuaacuccgaggacgagcaccuucuggcccucgaacgcaagcugaaaaagaugcuggggccuucugcggucgagaucggcaauggauguuucgaaacaaaacauaagugcaaccagaccugccucgauagaauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucucgggauaauguguccuguagcaucugccuguga

SEQ ID NO: 210257 - RNA, 1758 nt, Artificial Sequence; identical to SEQ ID NO: 209538
  derived and/or modified sequence opt5 from hemagglutinin__InfluenzaB__AGX18523

SEQ ID NO: 210258 - RNA, 1758 nt, Artificial Sequence; identical to SEQ ID NO: 209538
  derived and/or modified sequence opt5 from hemagglutinin__InfluenzaB__AGX18534

SEQ ID NO: 210259 - RNA, 1758 nt, Artificial Sequence; identical to SEQ ID NO: 209599
  derived and/or modified sequence opt5 from hemagglutinin__InfluenzaB__AGX18545

SEQ ID NO: 210260 - RNA, 1758 nt, Artificial Sequence; identical to SEQ ID NO: 209538
  derived and/or modified sequence opt5 from hemagglutinin__InfluenzaB__AGX18556

SEQ ID NO: 210261 - RNA, 1758 nt, Artificial Sequence; identical to SEQ ID NO: 209538
  derived and/or modified sequence opt5 from hemagglutinin__InfluenzaB__AGX18567

SEQ ID NO: 210262 - RNA, 1758 nt, Artificial Sequence
  derived and/or modified sequence opt5 from hemagglutinin__InfluenzaB__AGX18578
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaaaaacaagaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaagcugacugucuccaugagaaguauggcgggcugaacaaaucuaagcccuacuacacaggagagcacgccaaggcgauuggcaauugccccaucugggucaaaaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgagccacggcgcccacgggguggcuguugcggccgaucucaaguccacccaggaggcuaucaauaagauuaccaaaaaccugaauagccuuucugaacuggaggugaagaaccuccagcgccuguccggagccauggacgagcugcauaaagaaauccucgagcuggaugaaaaggucgacgaccuuagagccgauacaauuagcucucaaaucgagcuggcugugcuccugagcaaugaaggcaucauuaacuccgaggacgagcaccuucuggcccucgaacggaaacugaagaagaugcuggggccuucugcggucgagaucggcaauggauguuucgaaacaaaacauaagugcaaccagaccugccucgaucgcauugcugccggcacguuugacgccggggaguucagccugcccaccuuugauucccuuaauaucacagcugccagccugaacgacgauggacucgacaaucacaccauucugcuguauuacucuacagcugccuccagccuugcggugacccucaugaucgccauuuucguuguguauauggucucuagagauaacguguccuguagcaucugccuguga

SEQ ID NO: 210263 - RNA, 1758 nt, Artificial Sequence
  derived and/or modified sequence opt5 from hemagglutinin__InfluenzaB__AGX18589
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacacagaaacccagauggccaaacuuuauggggauuccaagccccagaaguuuacaagcucugcuaacggaguuaccacgcacuacgugucccaaaucggcgacuucccgaaucagacagaggauggcgggcugccucagagcggaagaaucguggucgacuauauggugcagaagucuggcaaaaccgggaccauuacauaccaacggggaauccuccugccccagaagguuuggugcgccuccggccgcagcaaagugauuaaggggucccuuccucugaucggagaagcugauugucuccaugagaaauauggcggccugaacaagucuaaacccuacuacaccggggagcacgccaaggcgauuggaaauugccccaucugggucaagacaccucugaaacucgccaacggcacgaaguauagaccgcccgcuaaacugcuuaaggaacggggguuuuucggagccaucgcuggcuuucuggaagggggcugggagggaaugauugccggcuggcauggguacaccagccacggagcccacggcguggcuguugcggccgaccucaaauccacacaggaggcuaucaauaagauuaccaagaaccugaauagccuuucugaacuggaggugaaaaaccuccagcgccuguccggggccauggaugagcugcauaaugaaauccucgagcuggacgaaaaggucgacgaucuuagagccgacacaauuagcucucaaaucgagcuggcugugcuccugagcaacgaaggaaucauuaauuccgaggaugagcaccuucuggcccucgaacggaaacugaagaaaaugcugggcccuucugcggucgagaucgggaacggcuguuucgaaaccaagcauaagugcaaucagacgugccucgaccgcauugcugccggaaccuuugaugccggcgaguucagccugcccacauuugacucccuuaacaucaccgcugccagccugaaugaugacgggcucgauaaccacacaauucugcuguauuacucuaccgcugccuccagccuugcggugacgcucaugaucgccauuuucguuguguauauggucucuagagacaacguguccuguagcaucugccuguga

SEQ ID NO: 210264 - RNA, 1758 nt, Artificial Sequence; identical to SEQ ID NO: 209538
  derived and/or modified sequence opt5 from hemagglutinin__InfluenzaB__AGX18600

SEQ ID NO: 210265 - RNA, 1758 nt, Artificial Sequence; identical to SEQ ID NO: 209538
  derived and/or modified sequence opt5 from hemagglutinin__InfluenzaB__AGX18611

SEQ ID NO: 210266 - RNA, 1758 nt, Artificial Sequence; identical to SEQ ID NO: 209538
  derived and/or modified sequence opt5 from hemagglutinin__InfluenzaB__AGX18622

SEQ ID NO: 210267 - RNA, 1758 nt, Artificial Sequence; identical to SEQ ID NO: 209538
  derived and/or modified sequence opt5 from hemagglutinin__InfluenzaB__AGX18633

SEQ ID NO: 210268 - RNA, 1758 nt, Artificial Sequence; identical to SEQ ID NO: 209538
  derived and/or modified sequence opt5 from hemagglutinin__InfluenzaB__AGX18644

SEQ ID NO: 210269 - RNA, 1758 nt, Artificial Sequence; identical to SEQ ID NO: 209538
  derived and/or modified sequence opt5 from hemagglutinin__InfluenzaB__AGX18655

SEQ ID NO: 210270 - RNA, 1758 nt, Artificial Sequence; identical to SEQ ID NO: 209538
  derived and/or modified sequence opt5 from hemagglutinin__InfluenzaB__AGX18666

SEQ ID NO: 210271 - RNA, 1758 nt, Artificial Sequence; identical to SEQ ID NO: 209538
  derived and/or modified sequence opt5 from hemagglutinin__InfluenzaB__AGX18677

SEQ ID NO: 210272 - RNA, 1758 nt, Artificial Sequence; identical to SEQ ID NO: 209538
  derived and/or modified sequence opt5 from hemagglutinin__InfluenzaB__AGX18688

SEQ ID NO: 210273 - RNA, 1758 nt, Artificial Sequence; identical to SEQ ID NO: 209538
  derived and/or modified sequence opt5 from hemagglutinin__InfluenzaB__AGX18699

SEQ ID NO: 210274 - RNA, 1758 nt, Artificial Sequence; identical to SEQ ID NO: 209538
  derived and/or modified sequence opt5 from hemagglutinin__InfluenzaB__AGX18710

SEQ ID NO: 210275 - RNA, 1758 nt, Artificial Sequence; identical to SEQ ID NO: 209538
  derived and/or modified sequence opt5 from hemagglutinin__InfluenzaB__AGX18721

SEQ ID NO: 210276 - RNA, 1758 nt, Artificial Sequence; identical to SEQ ID NO: 209538
  derived and/or modified sequence opt5 from hemagglutinin__InfluenzaB__AGX18732

SEQ ID NO: 210277 - RNA, 1758 nt, Artificial Sequence
  derived and/or modified sequence opt5 from hemagglutinin__InfluenzaB__AGX18743
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuaaucauaacgugauuaaugccgagaacgcuccgggcggccccuauaaaaucgggacgagcggauccugcccuaaugucacaaacggcaauggguucuuugccaccauggcuugggccgugcccaagaacgacaauaacaaaacagcgaccaacagccugaccauugaagugccuuacaucuguacagagggagaggaucagauuacggucuggggcuuccacucugacaaugaaacccagauggccaaacuuuauggggauuccaagccccagaaguuuacaagcucugcuaacggaguuaccacacacuacgugucccaaaucggcggcuucccgaaucagaccgaggacgggggacugccucagagcggcagaaucguggucgauuauauggugcagaagucugggaaaacgggaacaauuaccuaccaacggggcauccuccugccccagaagguuuggugcgccuccgggcgcagcaaagugauuaagggaucccuuccucugaucggcgaagcugacugucuccaugagaaauauggcgggcugaacaagucuaaacccuacuacaccggagagcacgccaaggcgauuggcaauugccccaucugggucaagacaccucugaaacucgccaacgggaccaaguauagaccgcccgcuaaacugcuuaaggaacggggauuuuucggcgccaucgcuggguuucuggagggcggaugggaaggcaugauugccggguggcauggauacacaagccacggcgcccacgggguggcuguugcggccgaucucaaauccacgcaggaggcuaucaauaagauuaccaagaaccugaauagccuuucugaacuggaggugaaaaaccuccagcgccuguccggagccauggacgagcugcauaaugaaauccucgagcuggaugaaaaggucgacgaccuuagagccgauacaauuagcucucaaaucgagcuggcugugcuccugagcaacgaaggcaucauuaauuccgaggacgagcaccuucuggcccucgaacggaaacugaagaaaaugcuggggccuucugcggucgagaucggcaacggauguuucgaaaccaagcauaagugcaaucagacaugccucgaucgcauugcugccggcaccuuugacgccggggaguucagccugcccacguuugauucccuuaacaucaccgcugccagccugaacgacgauggacucgacaaucacacaauucugcuguauuacucuaccgcugccuccagccuugcggugacacucaugaucgccauuuucguuguguauauggucucuagagauaacguguccuguagcaucugccuguga

SEQ ID NO: 210278 - RNA, 1758 nt, Artificial Sequence; identical to SEQ ID NO: 209538
  derived and/or modified sequence opt5 from hemagglutinin__InfluenzaB__AGX18754

SEQ ID NO: 210279 - RNA, 1758 nt, Artificial Sequence; identical to SEQ ID NO: 209538
  derived and/or modified sequence opt5 from hemagglutinin__InfluenzaB__AGX18765

SEQ ID NO: 210280 - RNA, 1758 nt, Artificial Sequence; identical to SEQ ID NO: 209589
  derived and/or modified sequence opt5 from hemagglutinin__InfluenzaB__AGX18776

SEQ ID NO: 210281 - RNA, 1758 nt, Artificial Sequence; identical to SEQ ID NO: 209538
  derived and/or modified sequence opt5 from hemagglutinin__InfluenzaB__AGX18787

SEQ ID NO: 210282 - RNA, 1758 nt, Artificial Sequence; identical to SEQ ID NO: 209538
  derived and/or modified sequence opt5 from hemagglutinin__InfluenzaB__AGX18798

SEQ ID NO: 210283 - RNA, 1758 nt, Artificial Sequence
  derived and/or modified sequence opt5 from hemagglutinin__InfluenzaB__AGX18809
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacuccgaaacacagauggccaagcuguauggggauagcaaaccccagaaguuuaccucuuccgcuaacggaguuacaacccacuacgugagccaaaucggcggcuucccgaaucagacggaggacgggggacugccucagucuggcagaaucguggucgauuauaugaugcagaaguccgggaaaacaggaaccauuaccuaccaacggggcauccuccugccccagaagguguggugcgccagcgggcgcuccaaaguuauuaagggaucucuuccucugaucggcgaagcugacugucuccaugagaaauauggcgggcugaacaagagcaaacccuacuacacaggagagcacgccaaggcgauuggcaauugccccaucugggugaagaccccucugaaacucgccaacgggacaaaguauagaccgcccgcuaaacugcuuaaggaacggggauuuuucggcgccaucgcuggguuucuggagggcggaugggaaggcaugauugccggguggcauggauacacgucccacggcgcccacggggucgcuguggcggccgaucucaaaagcacccaggaggcuaucaauaagauuacaaagaaccuuaauucucuuuccgaacuggagguuaaaaaccuccagcgccugagcggagccauggacgagcugcauaaugaaauccucgagcuggaugaaaagguggacgaccuuagagccgauaccauuucuagccaaaucgagcuggcuguccuccuguccaacgaaggcaucauuaauucugaggacgagcaccuucuggcccucgaacggaaacugaagaaaaugcuggggccuagcgcgguggagaucggcaacggauguuucgaaacaaagcauaagugcaaucagaccugccucgaucgcauugcugccggcacguuugacgccggggaguucucccugcccaccuuugauagccuuaacaucacagcugccucucugaaugacgauggacucgacaaccacaccauucugcuguauuacuccacagcugccagcucucuugcggucacccucaugaucgccauuuucgugguuuauaugguguccagagauaacgucagcuguuccaucugccuguga

SEQ ID NO: 210284 - RNA, 1758 nt, Artificial Sequence; identical to SEQ ID NO: 210201
  derived and/or modified sequence opt5 from hemagglutinin__InfluenzaB__AGX18820

SEQ ID NO: 210285 - RNA, 1758 nt, Artificial Sequence; identical to SEQ ID NO: 209538
  derived and/or modified sequence opt5 from hemagglutinin__InfluenzaB__AGX18831

SEQ ID NO: 210286 - RNA, 1758 nt, Artificial Sequence; identical to SEQ ID NO: 209538
  derived and/or modified sequence opt5 from hemagglutinin__InfluenzaB__AGX18842

SEQ ID NO: 210287 - RNA, 1758 nt, Artificial Sequence; identical to SEQ ID NO: 209606
  derived and/or modified sequence opt5 from hemagglutinin__InfluenzaB__AGX18853

SEQ ID NO: 210288 - RNA, 1758 nt, Artificial Sequence
  derived and/or modified sequence opt5 from hemagglutinin__InfluenzaB__AGX18864
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacggaaacccgggggaagcugugucccaaaugccucaacuguacagaucuggacguggcucuuggacgcccuaagugcaccggcaauauucccucugccagagucagcauccugcaugaggugcggccuguuacauccggguguuuucccaucaugcacgaucgcaccaagauuagacaacucccuaaccugcugcggggauaugaacauauccgccucucuaaucacaacgugauuaaugccgagaacgcuccgggcggccccuacaaaaucgggacgagcggauccugcccuaaugucacaaacggcaauggguucuuugccaccauggcuugggccgugcccaagaacgacaauaacaaaacagcgaccaacagccugaccauugaagugccuuauaucuguacagagggagaggaucagauuacggucuggggcuuccauucugacaaugaagcccagauggcuaaacuuuacggggauuccaagccccagaaguuuaccagcucugccaacggaguuacaacccacuaugugucccaaaucggcggcuucccgaaucagacagaggacgggggacugccucagagcggcagaaucguggucgauuacauggugcagaagucugggaaaaccggaacgauuacauaucaacggggcauccuccugccccagaagguuuggugcgcuuccgggcgcagcaaagugauuaagggaucccuuccucugaucggcgaagccgacugucuccacgagaaauacggcgggcugaacaagucuaaacccuacuauaccggagagcaugcgaaggccauuggcaauugccccaucugggucaagaccccucugaaacucgcuaacgggacaaaguacagaccgcccgccaaacugcuuaaggaacggggauuuuucggcgcuaucgccggguuucuggagggcggaugggaaggcaugauugccggguggcacggauauaccagccauggcgcucacgggguggcgguugccgcugaucucaaauccacacaggaggccaucaauaagauuacgaagaaccugaauagccuuucugaacuggaggugaaaaaccuccagcgccuguccggagccauggacgagcugcacaaugaaauccucgagcuggaugaaaaggucgacgaccuuagagcugauaccauuagcucucaaaucgagcuggccgugcuccugagcaacgaaggcaucauuaauuccgaggacgagcaucuucuggcgcucgaacggaaacugaagaaaaugcuggggccuucugcugucgagaucggcaacggauguuucgaaacaaagcacaagugcaaucagaccugccucgaucgcauugccgccggcacauuugacgcuggggaguucagccugcccaccuuugauucccuuaacaucacggccgcuagccugaacgacgauggacucgacaaucauaccauucugcuguacuauucuacagccgcguccagccuugccgugacccucaugaucgcuauuuucguuguguacauggucucuagagauaacguguccuguagcaucugccuguga

SEQ ID NO: 210289 - RNA, 1758 nt, Artificial Sequence
  derived and/or modified sequence opt5 from hemagglutinin__InfluenzaB__AGX18875
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauagaaacggcuucuuugccacaauggcuugggccgugcccaagaaugacaacaauaaaaccgcgaccaacagccugacaauugaagugccuuacaucuguacggagggggaggaucagauuaccgucuggggauuccacucugacaacgaaauccagauggccaaacuuuauggcgauuccaagccccagaaguuuacaagcucugcuaaugggguuaccacacacuacgugucccaaaucggaggcuucccgaaccagaccgaggacggcgggcugccucagagcggacggauuguggucgauuauauggugcagaagucuggcaaaacggggacaaucaccuaccaacgcgggauucuccugccccagaagguuuggugcgccuccggcagaagcaaagugaucaaggggucccuuccucugauuggagaagcugacugucuccaugagaaauauggcggccugaauaagucuaaacccuacuacaccggggagcacgccaaggcgaucggaaacugccccaucugggucaagacaccucugaaacucgccaauggcaccaaguaucggccgcccgcuaaacugcuuaaggaacgcggguuuuucggagccauugcuggcuuucuggagggaggcugggaaggaaugaucgccggcuggcauggguacacaagccacggagcccacggcguggcuguugcggccgaucucaaauccacgcaggaggcuauuaacaagaucaccaagaaucugaacagccuuucugaacuggaggugaaaaaucuccagagacuguccggggccauugacgagcugcauaacgaaauccucgagcuggaugaaaaggucgacgaccuucgggccgauacaaucagcucucaaauugagcuggcugugcuccugagcaaugaaggaaucauuaacuccgaggacgagcaccuucuggcccucgaacgcaaacugaagaaaaugcugggcccuucugcggucgagaucgggaauggcuguuucgaaaccaagcauaagugcaaccagacaugccucgauagaauugcugccggaaccuuugacgccggcgaguucagccugcccacguuugauucccuuaauaucaccgcugccagccugaacgacgaugggcucgacaaccacacaauucugcuguauuacucuaccgcugccuccagccuugcggugacacucaugaucgccaucuucguuguguauauggucucucgggauaauguguccuguagcauuugccuguga

SEQ ID NO: 210290 - RNA, 1758 nt, Artificial Sequence
  derived and/or modified sequence opt5 from hemagglutinin__InfluenzaB__AGX18886
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaauccagauggccaaacuuuauggggauuccaagccccagaaguuuacaagcucugcuaauggaguuaccacacacuacgugucccaaaucggcggcuucccgaaccagaccgaggacgggggacugccucagagcggcagaauuguggucgauuauauggugcagaagucugggaaaacgggaacaaucaccuaccaacggggcauucuccugccccagaagguuuggugcgccuccgggcgcagcaaagugaucaagggaucccuuccucugauuggcgaagcugacugucuccaugagaaauauggcgggcugaauaagucuaaacccuacuacaccggagagcacgccaaggcgaucggcaacugccccaucugggucaagacaccucugaaacucgccaaugggaccaaguauagaccgcccgcuaaacugcuuaaggaacggggauuuuucggcgccauugcuggguuucuggagggcggaugggaaggcaugaucgccggguggcauggauacacaagccacggcgcccacgggguggcuguugcggccgaucucaaauccacgcaggaggcuauuaacaagaucaccaagaaucugaacagccuuucugaacuggaggugaaaaaucuccagcgccuguccggagccauggacgagcugcauaacgaaauucucgagcuggaugaaaaggucgacgaccuuagagccgauacaaucagcucucaaaucgagcuggcugugcuccugagcaaugaaggcauuaucaacuccgaggacgagcaccuucuggcccucgaacggaaacugaagaaaaugcuggggccuucugcggucgagauuggcaauggauguuucgaaaccaagcauaagugcaaccagacaugccucgaucgcaucgcugccggcaccuuugacgccggggaguucagccugcccacguuugauucccuuaauauuaccgcugccagccugaacgacaacggacucgauaaucacacaauccugcuguauuacucuaccgcugccuccagccuugcggugacacucauuaucgccaucuucguuguguauauggucucuagagacaacguguccuguagcauuugccuguga

SEQ ID NO: 210291 - RNA, 1758 nt, Artificial Sequence; identical to SEQ ID NO: 210011
  derived and/or modified sequence opt5 from hemagglutinin__InfluenzaB__AGX18897

SEQ ID NO: 210292 - RNA, 1758 nt, Artificial Sequence; identical to SEQ ID NO: 209538
  derived and/or modified sequence opt5 from hemagglutinin__InfluenzaB__AGX18908

SEQ ID NO: 210293 - RNA, 1758 nt, Artificial Sequence; identical to SEQ ID NO: 209538
  derived and/or modified sequence opt5 from hemagglutinin__InfluenzaB__AGX18919

SEQ ID NO: 210294 - RNA, 1758 nt, Artificial Sequence
  derived and/or modified sequence opt5 from hemagglutinin__InfluenzaB__AGX18930
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugcauugaucgcaucgcugccggcacguuugacgccggggaguucagccuccccaccuuugauucccugaauauuacagcugccagccuuaacgacgauggacuggacaaccacaccauccuccuguauuacucuacagcugccuccagccuggcggugacccuuaugauugccaucuucguuguguauauggucucuagagauaauguguccuguagcaucugccucuga

SEQ ID NO: 210295 - RNA, 1758 nt, Artificial Sequence; identical to SEQ ID NO: 209538
  derived and/or modified sequence opt5 from hemagglutinin__InfluenzaB__AGX18941

SEQ ID NO: 210296 - RNA, 1758 nt, Artificial Sequence; identical to SEQ ID NO: 209538
  derived and/or modified sequence opt5 from hemagglutinin__InfluenzaB__AGX18952

SEQ ID NO: 210297 - RNA, 1758 nt, Artificial Sequence; identical to SEQ ID NO: 209538
  derived and/or modified sequence opt5 from hemagglutinin__InfluenzaB__AGX18963

SEQ ID NO: 210298 - RNA, 1758 nt, Artificial Sequence
  derived and/or modified sequence opt5 from hemagglutinin__InfluenzaB__AGX18974
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaaaccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaaaagaagcugaaaaagaugcuggggccuucugcggucgagaucggcaauggauguuucgaaacaaagcauaaaugcaaccagaccugccucgaucggauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucucgcgauaauguguccuguagcaucugccuguga

SEQ ID NO: 210299 - RNA, 1758 nt, Artificial Sequence; identical to SEQ ID NO: 209538
  derived and/or modified sequence opt5 from hemagglutinin__InfluenzaB__AGX18985

SEQ ID NO: 210300 - RNA, 1758 nt, Artificial Sequence
  derived and/or modified sequence opt5 from hemagglutinin__InfluenzaB__AGX18996
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauacacccucugccagagucagcauucugcacgaggugcggccuguuaccuccggguguuuucccaucaugcaugaucgcacgaagaucagacaacucccuaaccugcugcggggauacgaacacauucgccucucuacacauaaugugaucaacgccgagaaugcuccgggcggccccuauaaaauugggaccagcggauccugcccuaacgucacaaauggcaacggguucuuugccaccauggcuugggccgugcccaagaaugacaacaauaaaaccgcgacaaacagccugacgaucgaagugccuuacauuuguaccgagggagaggaucagaucacagucuggggcuuccacucugacaacgggacccagauggccaaacuuuauggagauuccaagccccagaaguuuacaagcucugcuaauggcguuaccacgcacuacgugucccaaauuggcggguucccgaaccagacagaagacggaggccugccucagagcgggagaaucguggucgauuauauggugcagaagucuggaaaaaccggcaccaucacauaccaacgggggauucuccugccccagaagguuuggugcgccuccggacgcagcaaagugaucaagggcucccuuccucugauuggcgaggcugacugucuccaugaaaaauaugggggacugaauaagucuaaacccuacuacaccggcgagcacgccaaggcgaucgggaacugccccauuugggucaagacaccucugaaacucgccaauggaacgaaguauagaccgcccgcuaaacugcuuaaggagcggggcuuuuucggggccaucgcuggcuuucuggaaggaggcugggaggggaugaucgccggauggcauggcuacaccagccacggggcccacggaguggcuguugcggccgaucucaaauccacacaggaagcuauuaacaagaucaccaagaaucugaacagccuuucugagcuggaagugaaaaaucuccagcgccuguccggcgccauggacgagcugcauaacgagauucucgaacuggaugagaaggucgacgaccuuagagccgauacaaucagcucucaaauugaacuggcugugcuccugagcaaugaggggaucaucaacuccgaagacgagcaccuucuggcccucgagcggaaacugaagaaaaugcugggcccuucugcggucgaaauuggaaauggcuguuucgagaccaagcauaagugcaaccagacgugccucgaucgcaucgcugccgggaccuuugacgccggagaguucagccugcccacauuugauucccuuaauauuaccgcugccagccugaacgacgauggccucgacaaccacacaauccugcuguauuacucuaccgcugccuccagccuugcggugacgcucaugauugccaucuucguuguguauauggucucuagagauaauguguccuguagcauuugccuguga

SEQ ID NO: 210301 - RNA, 1758 nt, Artificial Sequence; identical to SEQ ID NO: 209538
  derived and/or modified sequence opt5 from hemagglutinin__InfluenzaB__AGX19007

SEQ ID NO: 210302 - RNA, 1758 nt, Artificial Sequence
  derived and/or modified sequence opt5 from hemagglutinin__InfluenzaB__AGX19018
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaacuuccugcggggauacgaacacauccgccugucuacgcauaaugugauuaacgccgagaaugcuccgggcggccccuauaaaaucgggacaagcggauccugcccuaacgucaccaauggcaacggguuuuucgccacaauggcuugggccgugcccaagaaugacaacaauaaaaccgcgaccaacagccucacaauugaagugccuuacaucuguacggagggagaggaucagauuaccgucuggggcuuucacucugacuccgaaacacagauggccaagcuguauggggauagcaaaccccagaaguucaccucuuccgcuaacggaguuacaacccacuacgugagccaaaucggcggcuuuccgaaucagacggaggacgggggacuuccucagucuggcagaaucguggucgauuauauggugcagaaguccgggaaaacaggaaccauuaccuaccaacggggcauccugcucccccagaagguuuggugcgccagcgggcgcuccaaagugauuaagggaucucugccucuuaucggcgaagcugacugucugcaugagaaauauggcgggcucaacaagagcaaacccuacuacacaggagagcacgccaaggcgauuggcaauugccccaucugggucaagaccccucugaaacuggccaacgggacaaaguauagaccgcccgcuaaacuccugaaggaacggggauucuuuggcgccaucgcuggguuccuugagggcggaugggaaggcaugauugccggguggcauggauacacgucccacggcgcccacgggguggcuguugcggccgaucugaaaagcacccaggaggcuaucaauaagauuacaaagaaccucaauucucuguccgaacuugaggugaaaaaccugcagcgccucagcggagccauggacgagcugcauaaugaaauccuggagcucgaugaaaaggucgacgaccugagagccgauaccauuucuagccaaaucgagcuugcugugcugcucuccaacgaaggcaucauuaauucugaggacgagcaucugcuugcccuggaacggaaacucaagaaaaugcuggggccuagcgcggucgagaucggcaacggauguuuugaaacaaagcacaagugcaaucagaccugccuggaucgcauugcugccggcacguucgacgccggggaguuuucccuccccaccuucgauagccugaacaucacagcugccucucuuaaugacgauggacuggacaaccacaccauucuccuguauuacuccacagcugccagcucucuggcggugacccuuaugaucgccauuuucguuguguauauggucuccagagauaacgugagcuguuccaucugccucuga

SEQ ID NO: 210303 - RNA, 1758 nt, Artificial Sequence; identical to SEQ ID NO: 210201
  derived and/or modified sequence opt5 from hemagglutinin__InfluenzaB__AGX19029

SEQ ID NO: 210304 - RNA, 1758 nt, Artificial Sequence; identical to SEQ ID NO: 209538
  derived and/or modified sequence opt5 from hemagglutinin__InfluenzaB__AGX19040

SEQ ID NO: 210305 - RNA, 1758 nt, Artificial Sequence
  derived and/or modified sequence opt5 from hemagglutinin__InfluenzaB__AGX19051
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacacagagaaugccccgggcggccccuauaaaaucgggaccagcggauccugcccuaacgucacaaauggcaacggguucuuugcuaccauggccugggcugugcccaagaaugacaacaauaaaaccgccacaaacagccugacgauugaagugccuuacaucuguaccgagggagaggaucagauuacagucuggggcuuccacucugacuccgaaacccagauggcgaagcuguauggggauagcaaaccccagaaguuuacaucuuccgccaacggaguuaccacgcacuacgugagccaaaucggcggcuucccgaaucagacagaggacgggggacugccucagucuggcagaaucguggucgauuauauggugcagaaguccgggaaaaccggaaccauuacauaccaacggggcauccuccugccccagaagguuuggugcgcuagcgggcgcuccaaagugauuaagggaucucuuccucugaucggcgaagccgacugucuccaugagaaauauggcgggcugaacaagagcaaacccuacuacaccggagagcacgcuaaggccauuggcaauugccccaucugggucaagacaccucugaaacucgcgaacgggacgaaguauagaccgcccgccaaacugcuuaaggaacggggauuuuucggcgcuaucgccggguuucuggagggcggaugggaaggcaugauugcuggguggcauggauacaccucccacggcgcccacgggguggccguugcugcggaucucaaaagcacacaggaggccaucaauaagauuaccaagaaccuuaauucucuuuccgaacuggaggugaaaaaccuccagcgccugagcggagcuauggacgagcugcauaaugaaauccucgagcuggaugaaaaggucgacgaccuuagagccgauacaauuucuagccaaaucgagcuggccgugcuccuguccaacgaaggcaucauuaauucugaggacgagcaccuucuggcucucgaacggaaacugaagaaaaugcuggggccuagcgccgucgagaucggcaacggauguuucgaaaccaagcauaagugcaaucagacgugccucgaucgcauugcggcuggcaccuuugacgccggggaguucucccugcccacauuugauagccuuaacaucaccgccgcuucucugaaugacgauggacucgacaaccacacaauucugcuguauuacuccaccgccgcuagcucucuugccgugacgcucaugaucgcgauuuucguuguguauauggucuccagagauaacgugagcuguuccaucugccuguga

SEQ ID NO: 210306 - RNA, 1758 nt, Artificial Sequence
  derived and/or modified sequence opt5 from hemagglutinin__InfluenzaB__AGX19062
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaagcuguauggggauuccaaaccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaauuucaacagccugucugaacuugaggugaaaaaucugcagcgccucuccggagccauggacgagcugcauaacgaaauccuggagcucgaugaaaaggucgacgaccugagagccgauaccauuagcucucaaaucgagcuugcugugcugcucagcaaugaaggcaucauuaacuccgaggacgagcaccuucuugcccuggaacggaaacucaagaaaaugcuggggccuucugcggucgagaucggcaauggauguuuugaaacaaagcauaagugcaaccagaccugccuggaucgcauugcugccggcacguucgacgccggggaguuuagccuccccaccuucgauucccugaauaucacagcugccagccuuaacgacgauggacuggacaaccacaccauucuccuguauuacucuacagcugccuccagccuggcggugacccuuaugaucgccauuuucguuguguauauggucucuagagauaauguguccuguagcaucugccucuga

SEQ ID NO: 210307 - RNA, 1758 nt, Artificial Sequence; identical to SEQ ID NO: 209538
  derived and/or modified sequence opt5 from hemagglutinin__InfluenzaB__AGX19073

SEQ ID NO: 210308 - RNA, 1758 nt, Artificial Sequence
  derived and/or modified sequence opt5 from hemagglutinin__InfluenzaB__AGX19084
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacaucaaacucucuacgcauaaugugauuaacgccgagaaugcuccgggcggccccuauaagaucgggacaagcggauccugcccuaacgucaccaauggcaacggguucuuugccacaauggcuugggccgugcccaaaaaugacaacaauaagaccgcgaccaacagccugacaauugaagugccuuacaucuguacggagggagaggaucagauuaccgucuggggcuuccacucugacaacgaaaaucagauggccaaacuuuauggggauuccaagccccagaaguuuacaagcucugcuaacggaguuaccacacacuacgugucccaaaucggcggcuucccgaaucagaccgaggacgggggacugccucagagcggccgcaucguggucgauuauauggugcagaaaucugggaagacgggaacaauuaccuaccaaagaggcauccuccugccccagaaaguuuggugcgccuccgggcggagcaaggugauuaaaggaucccuuccucugaucggcgaagcugacugucuccaugagaaguauggcgggcugaacaaaucuaagcccuacuacaccggagagcacgccaaggcgauuggcaauugccccaucugggucaaaacaccucugaagcucgccaacgggaccaaauaucgcccgcccgcuaagcugcuuaaagaaagaggauuuuucggcgccaucgcuggguuucuggagggcggaugggaaggcaugauugccggguggcauggauacacaagccacggcgcccacgggguggcuguugcggccgaucucaaguccacgcaggaggcuaucaauaagauuaccaaaaaccugaauagccuuucugaacuggaggugaagaaccuccagcggcuguccggagccauggacgagcugcauaaugaaauccucgagcuggaugaaaaagucgacgaccuucgcgccgauacaauuagcucucaaaucgagcuggcugugcuccugagcaacgaaggcaucauuaauuccgaggacgagcaccuucuggcccucgaaagaaagcugaaaaagaugcuggggccuucugcggucgagaucggcaacggauguuucgaaaccaagcauaaaugcaaucagacaugccucgaucggauugcugccggcaccuuugacgccggggaguucagccugcccacguuugauucccuuaacaucaccgcugccagccugaacgacgauggacucgacaaucacacaauucugcuguauuacucuaccgcugccuccagccuugcggugacacucaugaucgccauuuucguuguguauauggucucucgcgauaacguguccuguagcaucugccuguga

SEQ ID NO: 210309 - RNA, 1758 nt, Artificial Sequence; identical to SEQ ID NO: 209538
  derived and/or modified sequence opt5 from hemagglutinin__InfluenzaB__AGX19095

SEQ ID NO: 210310 - RNA, 1758 nt, Artificial Sequence; identical to SEQ ID NO: 210201
  derived and/or modified sequence opt5 from hemagglutinin__InfluenzaB__AGX19106

SEQ ID NO: 210311 - RNA, 1758 nt, Artificial Sequence; identical to SEQ ID NO: 209538
  derived and/or modified sequence opt5 from hemagglutinin__InfluenzaB__AGX19117

SEQ ID NO: 210312 - RNA, 1758 nt, Artificial Sequence
  derived and/or modified sequence opt5 from hemagglutinin__InfluenzaB__AGX19128
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauacacccucugccagagucagcauucugcacgaggugcggccuguuaccuccggguguuuucccaucaugcaugaucgcacgaagaucagacaacucccuaaccugcugcggggauacgaacacauucgccucucuacacauaaugugaucaacgccgagaaugcuccgggcggccccuauaaaauugggaccagcggauccugcccuaacgucacaaauggcaacggguucuuugccaccauggcuugggccgugcccaagaaugacaacaauaaaaccgcgacaaacagccugacgaucgaagugccuuacauuuguaccgagggagaggaucagaucacagucuggggcuuccacucugacuccgaaacccagauggccaagcuguauggggauagcaaaccccagaaguuuacaucuuccgcuaacggaguuaccacgcacuacgugagccaaauuggcggcuucccgaaucagacagaggacgggggacugccucagucuggcagaaucguggucgauuauauggugcagaaguccgggaaaaccggaaccaucacauaccaacggggcauucuccugccccagaagguuuggugcgccagcgggcgcuccaaagugaucaagggaucucuuccucugauuggcgaagcugacugucuccaugagaaauauggcgggcugaacaagagcaaacccuacuacaccggagagcacgccaaggcgaucggcaauugccccauuugggucaagacaccucugaaacucgccaacgggacgaaguauagaccgcccgcuaaacugcuuaaggaacggggauuuuucggcgccaucgcuggguuucuggagggcggaugggaaggcaugaucgccggguggcauggauacaccucccacggcgcccacgggguggcuguugcggccgaucucaaaagcacacaggaggcuauuaauaagaucaccaagaaccuuaauucucuuuccgaacuggaggugaaaaaccuccagcgccugagcggagccauggacgagcugcauaaugaaauucucgagcuggaugaaaaggucgacgaccuuagagccgauacaaucucuagccaaauugagcuggcugugcuccuguccaacgaaggcaucaucaauucugaggacgagcaccuucuggcccucgaacggaaacugaagaaaaugcuggggccuagcgcggucgagauuggcaacggauguuucgaaaccaagcauaagugcaaucagacgugccucgaucgcaucgcugccggcaccuuugacgccggggaguucucccugcccacauuugauagccuuaacauuaccgcugccucucugaaugacgauggacucgacaaccacacaauccugcuguauuacuccaccgcugccagcucucuugcggugacgcucaugauugccaucuucguuguguauauggucuccagagauaacgugagcuguuccauuugccuguga

SEQ ID NO: 210313 - RNA, 1758 nt, Artificial Sequence; identical to SEQ ID NO: 209538
  derived and/or modified sequence opt5 from hemagglutinin__InfluenzaB__AGX19139

SEQ ID NO: 210314 - RNA, 1758 nt, Artificial Sequence; identical to SEQ ID NO: 210011
  derived and/or modified sequence opt5 from hemagglutinin__InfluenzaB__AGX19150

SEQ ID NO: 210315 - RNA, 1758 nt, Artificial Sequence; identical to SEQ ID NO: 209538
  derived and/or modified sequence opt5 from hemagglutinin__InfluenzaB__AGX19161

SEQ ID NO: 210316 - RNA, 1758 nt, Artificial Sequence; identical to SEQ ID NO: 210011
  derived and/or modified sequence opt5 from hemagglutinin__InfluenzaB__AGX19172

SEQ ID NO: 210317 - RNA, 1758 nt, Artificial Sequence
  derived and/or modified sequence opt5 from hemagglutinin__InfluenzaB__AGX19183
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacacagaaacccagauggccaaacuuuauggggauuccaagccccagaaguuuacaagcucugcuaacggaguuaccacgcacuacgugucccaaaucggcggcuucccgaaucagacagaggacgggggacugccucagagcggcagaaucguggucgauuauauggugcagaagucugggaaaaccggaaccauuacauaccaacggggcauccuccugccccagaagguuuggugcgccuccgggcgcagcaaagugauuaagggaucccuuccucugaucggcgaagcugacugucuccaugagaaauauggcgggcugaacaagucuaaacccuacuacaccggagagcacgccaaggcgauuggcaauugccccaucugggucaagacaccucugaaacucgccaacgggacgaaguauagaccgcccgcuaaacugcuuaaggaacggggauuuuucggcgccaucgcuggguuucuggagggcggaugggaaggcaugauugccggguggcauggauacaccagccacggcgcccacgggguggcuguugcggccgaucucaaauccacacaggaggcuaucaauaagauuaccaagaaccugaauagccuuucugaacuggaggugaaaaaccuccagcgccuguccggagccauggacgagcugcauaaugaaauccucgagcuggaugaaaaggucgacgaccuuagagccgauacaauuagcucucaaaucgagcuggcugugcuccugagcaacgaaggcaucauuaauuccgaggacgagcaccuucuggcccucgaacggaaacugaagaaaaugcuggggccuucugcggucgagaucggcaacggauguuucgaaaccaagcauaagugcaaucagacgugccucgaucgcauugcugccggcaccuuugacgccggggaguucagccugcccacauuugauucccuuaacaucaccgcugccagccugaaugacgauggacucgacaaccacacaauucugcuguauuacucuaccgcugccuccagccuugcggugacgcucaugaucgccauuuucguuguguauauggucucuagagauaacguguccuguagcaucugccuguga

SEQ ID NO: 210318 - RNA, 1758 nt, Artificial Sequence; identical to SEQ ID NO: 209538
  derived and/or modified sequence opt5 from hemagglutinin__InfluenzaB__AGX19194

SEQ ID NO: 210319 - RNA, 1758 nt, Artificial Sequence
  derived and/or modified sequence opt5 from hemagglutinin__InfluenzaB__AGX19205
augaaggccaucauugugcugcucauggucguuaccagcaacgcugacagagugugcacaggcaucacguccucuaauagcccccacguggucaaaaccgccacacagggggaggugaacguuaccggagugauuccucugacaaccacaccgaccaagucccauuucgcgaaucuuaaaggcacggaaacccgggggaagcugugucccaaaugccucaacuguacagaucuggacgucgcucuuggacgcccuaagugcaccggcaauauccccucugccagagugagcauucugcacgagguucggccugugacauccggguguuuucccaucaugcaugaucgcaccaagaucagacaacucccuaaccugcugcggggauacgaacacauucgccucucuacgcauaaugucaucaacgccgagaaugcuccgggcggccccuauaaaauugggacaagcggauccugcccuaacgugaccaauggcaacggguucuuugccacaauggcuugggccgugcccaagaaugacaacaauaaaaccgcgaccaacagccugacaaucgaagucccuuacauuuguacggagggagaggaucagaucaccguuuggggcuuccacucugacaacgaaacacagauggccaaacuuuauggggauuccaagccccagaaguuuaccagcucugcuaauggagugacaacccacuacgugucccaaauuggcggcuucccgaaccagacggaggacgggggacugccucagagcggcagaaucgucguggauuauaugguucagaagucugggaaaacaggaaccaucaccuaccaacggggcauucuccugccccagaagguguggugcgccuccgggcgcagcaaagucaucaagggaucccuuccucugauuggcgaagcugacugucuccaugagaaauauggcgggcugaauaagucuaaacccuacuacacaggagagcacgccaaggcgaucggcaacugccccauuugggugaagaccccucugaaacucgccaaugggacaaaguauagaccgcccgcuaaacugcuuaaggaacggggauuuuucggcgccaucgcuggguuucuggagggcggaugggaaggcaugaucgccggguggcauggauacacgagccacggcgcccacgggguugcuguggcggccgaucucaaauccacccaggaggcuauuaacaagaucacaaagaaucugaacagccuuucugaacuggaggucaaaaaucuccagcgccuguccggagccauggacgagcugcauaacgaaauucucgagcuggaugaaaagguggacgaccuuagagccgauaccaucagcucucaaauugagcuggcuguccuccugagcaaugaaggcaucaucaacuccgaggacgagcaccuucuggcccucgaacggaaacugaagaaaaugcuggggccuucugcgguggagauuggcaauggauguuucgaaacaaagcauaagugcaaccagaccugccucgaucgcaucgcugccggcacguuugacgccggggaguucagccugcccaccuuugauucccuuaauauuacagcugccagccugaacgacgauggacucgacaaccacaccauccugcuguauuacucuacagcugccuccagccuugcgguuacccucaugauugccaucuucguggucuauauggugucuagagauaauguuuccuguagcauuugccuguga

SEQ ID NO: 210320 - RNA, 1758 nt, Artificial Sequence
  derived and/or modified sequence opt5 from hemagglutinin__InfluenzaB__AGX19216
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaacccggaacaauuaccuaccaacggggcauccuccugccucagaagguuuggugcgccuccgggcgcagcaaagugauuaagggaucccuuccccugaucggcgaagcugacugucuccaugagaaauauggcgggcugaauaagucuaaacccuacuacaccggagagcacgccaaggcgauuggcaacugcccuaucugggucaagacaccgcugaaacucgccaaugggaccaaguauagacccccugcuaaacugcuuaaggaacggggauuuuucggcgccaucgcuggguuucuggagggcggaugggaaggcaugauugccggguggcauggauacacaagccacggcgcccacgggguggcuguugcggccgaucucaaauccacgcaggaggcuaucaacaagauuaccaagaaucugaacagccuuucugaacuggaggugaaaaaucuccagcgccuguccggagccauggacgagcugcauaacgaaauccucgagcuggaugaaaaggucgacgaccuuagagccgauacaauuagcucucaaaucgagcuggcugugcuccugagcaaugaaggcaucauuaacuccgaggacgagcaccuucuggcccucgaacggaaacugaagaaaaugcuggggcccucugcggucgagaucggcaauggauguuucgaaaccaagcauaagugcaaccagacaugccucgaucgcauugcugccggcaccuuugacgccggggaguucagccugccuacguuugauucccuuaauaucaccgcugccagccugaacgacgauggacucgacaaccacacaauucugcuguauuacucuaccgcugccuccagccuugcggugacacucaugaucgccauuuucguuguguauauggucucuagagauaauguguccuguagcaucugccuguga

SEQ ID NO: 210321 - RNA, 1758 nt, Artificial Sequence
  derived and/or modified sequence opt5 from hemagglutinin__InfluenzaB__AGX19227
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcuguguccccaaugccucaacuguacagaucuggacguggcucuuggacgcccuaaaugcaccggcaauauucccucugccagagucagcauccugcacgaggugcggccuguuacauccggguguuuucccaucaugcaugaucgcaccaagauuagacagcucccuaaccugcugcggggauacgaacacauccgccucucuacgcauaaugugauuaacgccgagaaugcuccgggcggccccuauaagaucgggacaagcggauccugcccuaacgucaccaauggcaacggguucuuugccacaauggcuugggccgugcccaaaagcgacaauaacaagaccgcgaccaauucucugacaauugaagugccuuacaucuguacggagggagaggaucagauuaccgucuggggcuuccacuccgacaacgaaacacagauggccaaacuuuauggggauagcaagccccaaaaauuuaccucuuccgcuaacggaguuacaacccacuacgugagccagaucggcggcuucccgaaucagacggaggacgggggacugccucagucuggcagaaucguggucgauuauauggugcaaaaguccgggaagacaggaaccauuaccuaccagcggggcauccuccugccccagaaaguuuggugcgccagcgggcgcuccaaggugauuaaaggaucucuuccucugaucggcgaagcugacugucuccaugagaaguauggcgggcugaacaaaagcaagcccuacuacacaggagagcacgccaaagcgauuggcaauugccccaucugggucaagaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgucccacggcgcccacgggguggcuguugcggccgaucucaagagcacccaggaggcuaucaauaaaauuacaaagaaccuuaauucucuguccgaacuggaggugaagaaccuccaacgccugagcggagccauggacgagcugcauaaugaaauccucgagcuggaugaaaaagucgacgaccuuagagccgauaccauuucuagccagaucgagcuggcugugcuccuguccaacgaaggcaucauuaauucugaggacgagcaccuucuggcccucgaacggaagcugaaaaagaugcuggggccuagcgcggucgagaucggcaacggauguuucgaaacaaaacauaagugcaaucagaccugccucgaucgcauugcugccggcacguuugacgccggggaguucucccugcccaccuuugauagccuuaacaucacagcugccucucugaaugacgauggacucgacaaccacaccauucugcuguauuacuccacagcugccagcucucuugcggugacccucaugaucgccauuuucguuguguauauggucuccagagauaacgugagcuguuccaucugccuguga

SEQ ID NO: 210322 - RNA, 1758 nt, Artificial Sequence
  derived and/or modified sequence opt5 from hemagglutinin__InfluenzaB__AGX19238
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaaaaacaagaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaagcugacugucuccaugagaaguauggcgggcugaacaaaucuaagcccuacuacacaggagagcacgccaaggcgauuggcaauugccccaucugggucaaaaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgagccacggcgcccacgggguggcuguugcggccgaucucaaguccacccaggaggcuaucaauaagauuaccaaaaaccugaauagccuuucugaacuggaggugaagaaccuccagcgccuguccggagccauggacgagcugcauaaugaaauccucgagcuggaugaaaaagucgacgaccuuagagccgauacaauuagcucucaaaucgagcuggcugugcuccugagcaacgaaggcaucauuaauuccgaggacgagcaccuucuggcccucgaacggaagcugaaaaagaugcuggggccuucugcggucgagaucggcaacggauguuucgaaacaaagcauaaaugcaaucagaccugccucgaucgcauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucuagagauaacguguccuguagcaucugccuguga

SEQ ID NO: 210323 - RNA, 1758 nt, Artificial Sequence; identical to SEQ ID NO: 210322
  derived and/or modified sequence opt5 from hemagglutinin__InfluenzaB__AGX19249

SEQ ID NO: 210324 - RNA, 1758 nt, Artificial Sequence; identical to SEQ ID NO: 209538
  derived and/or modified sequence opt5 from hemagglutinin__InfluenzaB__AGX19260

SEQ ID NO: 210325 - RNA, 1758 nt, Artificial Sequence; identical to SEQ ID NO: 209538
  derived and/or modified sequence opt5 from hemagglutinin__InfluenzaB__AGX19271

SEQ ID NO: 210326 - RNA, 1758 nt, Artificial Sequence
  derived and/or modified sequence opt5 from hemagglutinin__InfluenzaB__AGX19282
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcacauccgggcgcagcaaagugauuaagggaucccuuccucugaucggcgaagccgacugucuccaugagaaauauggcgggcugaauaagucuaaacccuacuacaccggagagcacgcuaaggccauuggcaacugccccaucugggucaagacaccucugaaacucgcgaaugggacgaaguauagaccgcccgccaaacugcuuaaggaacggggauuuuucggcgcuaucgccggguuucuggagggcggaugggaaggcaugauugcuggguggcauggauacaccagccacggcgcccacgggguggccguugcugcggaucucaaauccacacaggaggccaucaacaagauuaccaagaaucugaacagccuuucugaacuggaggugaaaaaucuccagcgccuguccggagcuauggacgagcugcauaacgaaauccucgagcuggaugaaaaggucgacgaccuuagagccgauacaauuagcucucaaaucgagcuggccgugcuccugagcaaugaaggcaucauuaacuccgaggacgagcaccuucuggcucucgaacggaaacugaagaaaaugcuggggccuucugccgucgagaucggcaauggauguuucgaaaccaagcauaagugcaaccagacgugccucgaucgcauugcggcuggcaccuuugacgccggggaguucagccugcccacauuugauucccuuaauaucaccgccgcuagccugaacgacgauggacucgacaaccacacaauucugcuguauuacucuaccgccgcuuccagccuugccgugacgcucaugaucgcgauuuucguuguguauauggucucuagagauaauguguccuguagcaucugccuguga

SEQ ID NO: 210327 - RNA, 1758 nt, Artificial Sequence
  derived and/or modified sequence opt5 from hemagglutinin__InfluenzaB__AGX19304
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgauuaacagccugaccaucgaagugccuuacauuuguacagagggagaggaucagaucacggucuggggcuuccacucugacaacgaaacccagauggccaaacuuuauggggauuccaagccccagaaguuuacaagcucugcuaauggaguuaccacacacuacgugucccaaaucggcggcuucccgaaccagaccgaggacgggggacugccucagagcggcagaauuguggucgauuauauggugcagaagucugggaaaacgggaacaaucaccuaccaacggggcauucuccugccccagaagguuuggugcgccuccgggcgcagcaaagugaucaagggaucccuuccucugauuggcgaagcugacugucuccaugagaaauauggcgggcugaauaagucuaaacccuacuacaccggagagcacgccaaggcgaucggcaacugccccaucugggucaagacaccucugaaacucgccaaugggaccaaguauagaccgcccgcuaaacugcuuaaggaacggggauuuuucggcgccauugcuggguuucuggagggcggaugggaaggcaugaucgccggguggcauggauacacaagccacggcgcccacgggguggcuguugcggccgaucucaaauccacgcaggaggcuauuaacaagaucaccaagaaucugaacagccuuucugaacuggaggugaaaaaucuccagcgccuguccggagccauggacgagcugcauaacgaaauucucgagcuggaugaaaaggucgacgaccuuagagccgauacaaucagcucucaaaucgagcuggcugugcuccugagcaaugaaggcauuaucaacuccgaggacgagcaccuucuggcccucgaacggaaacugaagaaaaugcuggggccuucugcggucgagauuggcaauggauguuucgaaaccaagcauaagugcaaccagacaugccucgaucgcaucgcugccggcaccuuugacgccggggaguucagccugcccacguuugauucccuuaauauuaccgcugccagccugaacgacgauggacucgacaaccacacaauccugcuguauuacucuaccgcugccuccagccuugcggugacacucaugauugccaucuucguuguguauauggucucuagagauaauguguccuguagcaucugccuguga

SEQ ID NO: 210328 - RNA, 1758 nt, Artificial Sequence; identical to SEQ ID NO: 210327
  derived and/or modified sequence opt5 from hemagglutinin__InfluenzaB__AGX19315

SEQ ID NO: 210329 - RNA, 1758 nt, Artificial Sequence; identical to SEQ ID NO: 210326
  derived and/or modified sequence opt5 from hemagglutinin__InfluenzaB__AGX19326

SEQ ID NO: 210330 - RNA, 1758 nt, Artificial Sequence; identical to SEQ ID NO: 210326
  derived and/or modified sequence opt5 from hemagglutinin__InfluenzaB__AGX19337

SEQ ID NO: 210331 - RNA, 1758 nt, Artificial Sequence
  derived and/or modified sequence opt5 from hemagglutinin__InfluenzaB__AGX19348
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaagcccagauggcuaaacuuuauggggauuccaagccccagaaguuuacaagcucugccaauggaguuaccacacacuacgugucccaaaucggcggcuucccgaaccagaccgaggacgggggacugccucagagcggcagaaucguggucgauuauauggugcagaagucugggaaaacgggaacaauuaccuaccaacggggcauccuccugccccagaagguuuggugcaccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauguguccuguagcaucugccuguga

SEQ ID NO: 210332 - RNA, 1758 nt, Artificial Sequence; identical to SEQ ID NO: 210326
  derived and/or modified sequence opt5 from hemagglutinin__InfluenzaB__AGX19359

SEQ ID NO: 210333 - RNA, 1755 nt, Artificial Sequence; identical to SEQ ID NO: 209755
  derived and/or modified sequence opt5 from hemagglutinin__InfluenzaB__AGX19370

SEQ ID NO: 210334 - RNA, 1758 nt, Artificial Sequence; identical to SEQ ID NO: 209589
  derived and/or modified sequence opt5 from hemagglutinin__InfluenzaB__AGX19381

SEQ ID NO: 210335 - RNA, 1758 nt, Artificial Sequence; identical to SEQ ID NO: 210326
  derived and/or modified sequence opt5 from hemagglutinin__InfluenzaB__AGX19392

SEQ ID NO: 210336 - RNA, 1758 nt, Artificial Sequence; identical to SEQ ID NO: 210326
  derived and/or modified sequence opt5 from hemagglutinin__InfluenzaB__AGX19403

SEQ ID NO: 210337 - RNA, 1758 nt, Artificial Sequence; identical to SEQ ID NO: 210013
  derived and/or modified sequence opt5 from hemagglutinin__InfluenzaB__AGX19414

SEQ ID NO: 210338 - RNA, 1755 nt, Artificial Sequence
  derived and/or modified sequence opt5 from hemagglutinin__InfluenzaB__AGX19425
augaagaccaucauugugcugcucauggucguuacaagcaacgccgacagaaucugcacgggcauuaccuccucuaauagcccccacguggugaaaacagcuacccagggggaggucaacgugacaggaguuaucccucugaccacaaccccgacgaaguccuacuucgccaaucuuaaaggcacccggacacgcgggaagcugugucccgauugccucaacuguaccgaccuggauguggcgcuuggaagaccuaugugcgucggcacaacccccucugcuaaagccagcauucugcaugaagugcggccuguuacguccggguguuuucccaucaugcacgaccgcacaaagaucagacaacucccuaaucugcugcggggauaugagaacauucgccucucuacccagaaugugaucgaugccgaaaaggcuccgggcggccccuacagacuggggacaagcggauccugcccuaacgccaccagcaaaucuggcuucuuugcuaccauggccugggcgguccccaaggacaauaacaaaaaugccacaaacccucuuacgguggaggugcccuauauuuguaccgaaggggaggaucagaucacagucuggggauuccauuccgacaauaagacccagaugcggaaccuguacggcgauagcaauccgcaaaaauuuacaucuuccgcuaacgggguuaccacgcacuaugugagccagauuggaucuuucccugaccagacagaggauggcggccucccccaguccgggcgcaucguggucgacuacaugaugcaaaagccuggaaagaccggcaccauuguguaucagagagggguucugcuuccccagcggguguggugcgccagcggacgcuccaaagucaucaagggcgcucugccccucaucggggaagccgauugucugcaugagaaauacggaggccugaacaagucuaaaccuuacuauacaggcgaacacgcgaaggccauugggaauugcccgaucugggugaaaacaccccucaagcuggcuaacggaacaaaguacagaccucccgccaaacuucugaaggagcggggcuuuuucggggcuauugccggauuucucgagggcgggugggaaggcaugaucgccggauggcacggcuauacgagccauggggcucacggaguugcgguggccgcugaccugaaauccacccaggaggccauuaauaagaucaccaaaaaccuuaauagccugucugaacucgaggucaagaaccugcaacgccuguccggcgccauggacgaacuccauaaugagauccuggagcuugaugaaaagguggacgaucugagagcugacaccauuagcucucagaucgagcucgccguccugcuuagcaacgaagggauuaucaauuccgaggaugaacaucugcucgcgcuggagcggaaacugaagaaaaugcucggaccuucugcuguggagauuggcaacggguguuucgaaacaaagcacaaaugcaaucagaccugccuggacagaaucgccgccggcacguuuaacgcuggagaguucagccuucccaccuuugauucccugaauaucacagccgcuagccucaacgacgauggccuggacaaucacaccauucugcuuuacuauucuacagccgcguccagccucgccguuacccugaugcuggcuaucuucauuguguacauggucucucgcgauaacguguccuguagcaucugccucuga

SEQ ID NO: 210339 - RNA, 1758 nt, Artificial Sequence; identical to SEQ ID NO: 209538
  derived and/or modified sequence opt5 from hemagglutinin__InfluenzaB__AGX19436

SEQ ID NO: 210340 - RNA, 1758 nt, Artificial Sequence; identical to SEQ ID NO: 210201
  derived and/or modified sequence opt5 from hemagglutinin__InfluenzaB__AGX19447

SEQ ID NO: 210341 - RNA, 1755 nt, Artificial Sequence; identical to SEQ ID NO: 210080
  derived and/or modified sequence opt5 from hemagglutinin__InfluenzaB__AGX19458

SEQ ID NO: 210342 - RNA, 1755 nt, Artificial Sequence; identical to SEQ ID NO: 210080
  derived and/or modified sequence opt5 from hemagglutinin__InfluenzaB__AGX19469

SEQ ID NO: 210343 - RNA, 1758 nt, Artificial Sequence; identical to SEQ ID NO: 210013
  derived and/or modified sequence opt5 from hemagglutinin__InfluenzaB__AGX19480

SEQ ID NO: 210344 - RNA, 1758 nt, Artificial Sequence; identical to SEQ ID NO: 209606
  derived and/or modified sequence opt5 from hemagglutinin__InfluenzaB__AGX19491

SEQ ID NO: 210345 - RNA, 1758 nt, Artificial Sequence
  derived and/or modified sequence opt5 from hemagglutinin__InfluenzaB__AGX19502
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacucugaaacacagauggccaaacuuuauggggauuccaagccgcagaaguuuaccagcucugcuaauggagucacaacccacuacguuucccaaaucggcggcuucccuaaccagacggaggacgggggacugccccagagcggcagaauugugguggauuauaugguccagaagucugggaaaacaggaaccaucaccuaccaacggggcauucuccugccucagaagguguggugcgccuccgggcgcagcaaaguuaucaagggaucccuuccccugauuggcgaagcugacugucuccaugagaaauauggcgggcugaacaagucuaagcccuacuacacaggagagcacgccaaagcgaucggcaauugcccuaucugggugaagaccccgcugaaacucgccaacgggacaaaguauagacccccugcuaaacugcuuaaggaacggggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcgccuguccggagccauggacgagcugcauaaugaaauucucgagcuggaugaaaagguggacgaccuuagagccgauaccaucagcucucaaaucgagcuggcuguccuccugagcaacgaaggcauuaucaauuccgaggacgagcaccuucuggcccucgaacggaaacugaagaagaugcuggggcccucugcgguggagauuggcaacggauguuucgaaacaaaacauaagugcaaucagaccugccucgaucgcaucgcugccggcacguuugacgccggggaguucagccugccuaccuuugauucccuuaacauuacagcugccagccugaaugacgauggacucgacaaccacaccauccugcuguauuacucuacagcugccuccagccuugcggucacccucaugauugccaucuucgugguuuauauggugucuagagauaaugucuccuguagcaucugccuguga

SEQ ID NO: 210346 - RNA, 1758 nt, Artificial Sequence
  derived and/or modified sequence opt5 from hemagglutinin__InfluenzaB__AGX19513
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacaucucucaaauuggcggcuucccuaaccagacggaggacgggggacugccccaguccggcagaaucguuguggauuauauggugcaaaagagcgggaaaacaggaaccauuaccuaccagcggggcauccuccugccucagaaggucuggugcgccucugggcgcuccaaagugauuaagggaagccuuccccugaucggcgaagcugacugucuccaugagaaauauggcgggcugaauaaguccaagcccuacuacacaggagagcacgccaaagcgaucggcaacugcccuauuuggguuaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcugucgcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaagguugacgaccuuagagccgauaccaucuccagccaaauugagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccaucuucgucguguauaugguuagcagagauaacgugucuuguuccauuugccuguga

SEQ ID NO: 210347 - RNA, 1758 nt, Artificial Sequence; identical to SEQ ID NO: 210346
  derived and/or modified sequence opt5 from hemagglutinin__InfluenzaB__AGX19524

SEQ ID NO: 210348 - RNA, 1758 nt, Artificial Sequence
  derived and/or modified sequence opt5 from hemagglutinin__InfluenzaB__AGX19535
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacgaugaaacacagauggccaaacuuuauggggacuccaagccccagaaguuuaccagcucugcuaacggaguuacaacccacuacgugucccaaaucggcggcuucccgaaucagacggaggaugggggacugccucagagcggcagaaucguggucgacuauauggugcagaagucugggaaaacaggaaccauuaccuaccaacggggcauccuccugccccagaagguuuggugcgccuccgggcgcagcaaagugauuaagggaucccuuccucugaucggcgaagcugauugucuccaugagaaauauggcgggcugaacaagucuaaacccuacuacacaggagagcacgccaaggcgauuggcaauugccccaucugggucaagaccccucugaaacucgccaacgggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaccucaaauccacccaggaggcuaucaauaagauuacaaagaaccugaauagccuuucugaacuggaggugaaaaaccuccagcgccuguccggagccauggaugagcugcauaaugaaauccucgagcuggacgaaaaggucgacgaucuuagagccgacaccauuagcucucaaaucgagcuggcugugcuccugagcaacgaaggcaucauuaauuccgaggaugagcaccuucuggcccucgaacggaaacugaagaaaaugcuggggccuucugcggucgagaucggcaacggauguuucgaaacaaagcauaagugcaaucagaccugccucgaccgcauugcugccggcacguuugaugccggggaguucagccugcccaccuuugacucccuuaacaucacagcugccagccugaaugaugacggacucgauaaccacaccauucugcuguauuacucuacagcugccuccagccuugcggugacccucaugaucgccauuuucguuguguauauggucucuagagacaacguguccuguagcaucugccuguga

SEQ ID NO: 210349 - RNA, 1758 nt, Artificial Sequence
  derived and/or modified sequence opt5 from hemagglutinin__InfluenzaB__AGX19546
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaaggaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcgccuccgggcgcagcaaggugauuaaaggaucccuuccucugaucggcgaagcugacugucuccaugagaaguauggcgggcugaacaaaucuaagcccuacuacacaggagagcacgccaaggcgauuggcaauugccccaucugggucaaaaccccucugaagcucgccaacgggacaaaauauagaccgcccgcuaagcugcuuaaagaacggggauuuuucggcgccaucgcuggguuucuggagggcggaugggaaggcaugauugccggguggcauggauacacgagccacggcgcccacgggguggcuguugcggccgaucucaaguccacccaggaggcuaucaauaagauuaccaaaaaccugaauagccuuucugaacuggaggugaagaaccuccagcgccuguccggagccauggacgagcugcauaaugaaauccucgagcuggaugaaaaagucgacgaccuuagagccgauacaauuagcucucaaaucgagcuggcugugcuccugagcaacgaaggcaucauuaauuccgaggacgagcaccuucuggcccucgaacggaagcugaaaaagaugcuggggccuucugcggucgagaucggcaacggauguuucgaaacaaagcauaaaugcaaucagaccugccucgaucgcauugcugccggcacguuugacgccggggaguucagccugcccaccuuugauucccuuaacaucacagcugccagccugaaugacgauggacucgacaaccacaccauucugcuguauuacucuacagcugccuccagccuugcggugacccucaugaucgccauuuucguuguguauauggucucuagagauaacguguccuguagcaucugccuguga

SEQ ID NO: 210350 - RNA, 1758 nt, Artificial Sequence
  derived and/or modified sequence opt5 from hemagglutinin__InfluenzaB__AGX19557
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacgggaggcgaggaucagauuaccgucuggggguuccacucugacaacgagacacagauggccaaacuuuauggagauuccaagccccagaaguuuaccagcucugcuaauggcguuacaacccacuacgugucccaaaucggcggguucccgaaccagacggaagacggaggccugccucagagcgggagaaucguggucgauuauauggugcagaagucuggaaaaacaggcaccauuaccuaccaacgggggauccuccugccccagaagguuuggugcgccuccggacgcagcaaagugauuaagggcucccuuccucugaucggcgaggcugacugucuccaugaaaaauaugggggacugaauaagucuaaacccuacuacacaggcgagcacgccaaggcgauugggaacugccccaucugggucaagaccccucugaaacucgccaauggaacaaaguauagaccgcccgcuaaacugcuuaaggagcggggcuuuuucggggccaucgcuggcuuucuggaaggaggcugggaggggaugauugccggauggcauggcuacacgagccacggggcccacggaguggcuguugcggccgaucucaaauccacccaggaagcuaucaacaagauuacaaagaaucugaacagccuuucugagcuggaagugaaaaaucuccagcgccuguccggcgccauggacgagcugcauaacgagauccucgaacuggaugagaaggucgacgaccuuagagccgauaccauuagcucucaaaucgaacuggcugugcuccugagcaaugaggggaucauuaacuccgaagacgagcaccuucuggcccucgagcggaaacugaagaaaaugcugggcccuucugcggucgaaaucggaaauggcuguuucgagacaaagcauaagugcaaccagaccugccucgaucgcauugcugccgggacguuugacgccggagaguucagccugcccaccuuugauucccuuaauaucacagcugccagccugaacgacgauggccucgacaaccacaccauucugcuguauuacucuacagcugccuccagccuugcggugacccucaugaucgccauuuucguuguguauauggucucuagagauaauguguccuguagcaucugccuguga

SEQ ID NO: 210351 - RNA, 1758 nt, Artificial Sequence; identical to SEQ ID NO: 210013
  derived and/or modified sequence opt5 from hemagglutinin__InfluenzaB__AGX19568

SEQ ID NO: 210352 - RNA, 1758 nt, Artificial Sequence; identical to SEQ ID NO: 210346
  derived and/or modified sequence opt5 from hemagglutinin__InfluenzaB__AGX19579

SEQ ID NO: 210353 - RNA, 1758 nt, Artificial Sequence; identical to SEQ ID NO: 210013
  derived and/or modified sequence opt5 from hemagglutinin__InfluenzaB__AGX19590

SEQ ID NO: 210354 - RNA, 1758 nt, Artificial Sequence; identical to SEQ ID NO: 210013
  derived and/or modified sequence opt5 from hemagglutinin__InfluenzaB__AGX19601

SEQ ID NO: 210355 - RNA, 1758 nt, Artificial Sequence; identical to SEQ ID NO: 210013
  derived and/or modified sequence opt5 from hemagglutinin__InfluenzaB__AGX19612

SEQ ID NO: 210356 - RNA, 1758 nt, Artificial Sequence
  derived and/or modified sequence opt5 from hemagglutinin__InfluenzaB__AGX19623
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcgguggcccucaugaucgcuauuuucguuguguauauggucucuagagauaauguguccuguagcaucugccuguga

SEQ ID NO: 210357 - RNA, 1758 nt, Artificial Sequence; identical to SEQ ID NO: 210013
  derived and/or modified sequence opt5 from hemagglutinin__InfluenzaB__AGX19634

SEQ ID NO: 210358 - RNA, 1758 nt, Artificial Sequence; identical to SEQ ID NO: 209538
  derived and/or modified sequence opt5 from hemagglutinin__InfluenzaB__AGX19645

SEQ ID NO: 210359 - RNA, 1758 nt, Artificial Sequence; identical to SEQ ID NO: 209589
  derived and/or modified sequence opt5 from hemagglutinin__InfluenzaB__AGX19656

SEQ ID NO: 210360 - RNA, 1758 nt, Artificial Sequence
  derived and/or modified sequence opt5 from hemagglutinin__InfluenzaB__AGX19667
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaagaccuccagcgccugucuggagccauggaugagcugcauaaugaaauucucgagcuggacgaaaagguggacgaucuuagagccgacaccaucuccagccaaaucgagcuggcuguccuccugucuaacgaaggcauuaucaauagcgaggaugagcaccuucuggcccucgaacggaaacugaagaagaugcuggggcccuccgcgguggagauuggcaacggauguuucgaaacaaaacauaagugcaaucagaccugccucgaccgcaucgcugccggcacguuugaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaaugucucuuguuccaucugccuguga

SEQ ID NO: 210361 - RNA, 1758 nt, Artificial Sequence; identical to SEQ ID NO: 210013
  derived and/or modified sequence opt5 from hemagglutinin__InfluenzaB__AGX19678

SEQ ID NO: 210362 - RNA, 1758 nt, Artificial Sequence; identical to SEQ ID NO: 209538
  derived and/or modified sequence opt5 from hemagglutinin__InfluenzaB__AGX19700

SEQ ID NO: 210363 - RNA, 1758 nt, Artificial Sequence
  derived and/or modified sequence opt5 from hemagglutinin__InfluenzaB__AGX19711
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaaaaacaagaccgcgaccaauagccugacaauugaagugccuuacaucuguaaagagggagaggaucagauuacggucuggggcuuccacucugacaacgaaacccagauggccaaacuuuauggggauuccaagccccagaaguuuacaagcucugcuaacggaguuaccacacacuacgugucccaaaucggcggcuucccgaaucagaccgaggacgggggacugccucagagcggcagaaucguggucgauuauauggugcagaagucugggaaaacgggaacaauuaccuaccaacggggcauccuccugccccagaagguuuggugcgccuccgggcgcagcaaagugauuaagggaucccuuccucugaucggcgaagcugacugucuccaugagaaauauggcgggcugaacaagucuaagcccuacuacaccggagagcacgccaaagcgauuggcaauugccccaucugggucaagacaccucugaaacucgccaacgggaccaaguauagaccgcccgcuaaacugcuuaaggaacggggauuuuucggcgccaucgcuggguuucuggagggcggaugggaaggcaugauugccggguggcauggauacacaagccacggcgcccacgggguggcuguugcggccgaucucaaguccacgcaggaggcuaucaauaaaauuaccaagaaccugaauagccuuucugaacuggaggugaaaaaccuccagcgccuguccggagccauggacgagcugcauaaugaaauccucgagcuggaugaaaaggucgacgaccuuagagccgauacaauuagcucucaaaucgagcuggcugugcuccugagcaacgaaggcaucauuaauuccgaggacgagcaccuucuggcccucgaacggaaacugaagaagaugcuggggccuucugcggucgagaucggcaacggauguuucgaaaccaaacauaagugcaaucagacaugccucgaucgcauugcugccggcaccuuugacgccggggaguucagccugcccacguuugauucccuuaacaucaccgcugccagccugaaugacgauggacucgacaaccacacaauucugcuguauuacucuaccgcugccuccagccuugcggugacacucaugaucgccauuuucguuguguauauggucucuagagauaacguguccuguagcaucugccuguga

SEQ ID NO: 210364 - RNA, 1758 nt, Artificial Sequence; identical to SEQ ID NO: 210013
  derived and/or modified sequence opt5 from hemagglutinin__InfluenzaB__AGX19722

SEQ ID NO: 210365 - RNA, 1758 nt, Artificial Sequence; identical to SEQ ID NO: 210013
  derived and/or modified sequence opt5 from hemagglutinin__InfluenzaB__AGX19733

SEQ ID NO: 210366 - RNA, 1758 nt, Artificial Sequence; identical to SEQ ID NO: 210013
  derived and/or modified sequence opt5 from hemagglutinin__InfluenzaB__AGX19744

SEQ ID NO: 210367 - RNA, 1758 nt, Artificial Sequence; identical to SEQ ID NO: 209538
  derived and/or modified sequence opt5 from hemagglutinin__InfluenzaB__AGX19755

SEQ ID NO: 210368 - RNA, 1758 nt, Artificial Sequence; identical to SEQ ID NO: 210013
  derived and/or modified sequence opt5 from hemagglutinin__InfluenzaB__AGX19766

SEQ ID NO: 210369 - RNA, 1758 nt, Artificial Sequence; identical to SEQ ID NO: 210346
  derived and/or modified sequence opt5 from hemagglutinin__InfluenzaB__AGX19788

SEQ ID NO: 210370 - RNA, 1758 nt, Artificial Sequence; identical to SEQ ID NO: 210013
  derived and/or modified sequence opt5 from hemagglutinin__InfluenzaB__AGX19799

SEQ ID NO: 210371 - RNA, 1758 nt, Artificial Sequence; identical to SEQ ID NO: 210013
  derived and/or modified sequence opt5 from hemagglutinin__InfluenzaB__AGX19810

SEQ ID NO: 210372 - RNA, 1758 nt, Artificial Sequence
  derived and/or modified sequence opt5 from hemagglutinin__InfluenzaB__AGX19821
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggaagcauggacgagcugcauaacgaaauccucgagcuggaugaaaaggucgacgaccuuagagccgauaccauuucuagccaaaucgagcuggccgugcuccuguccaaugaaggcaucauuaacucugaggacgagcaccuucuggcucucgaacggaaacugaagaaaaugcuggggccuagcgccgucgagaucggcaauggauguuucgaaacaaagcauaagugcaaccagaccugccucgaucgcauugcggcuggcacguuugacgccggggaguucucccugcccaccuuugauagccuuaauaucacagccgcuucucugaacgacgauggacucgacaaccacaccauucugcuguauuacuccacagccgcuagcucucuugccgugacccucaugaucgcgauuuucguuguguauauggucuccagagauaaugugagcuguuccaucugccuguga

SEQ ID NO: 210373 - RNA, 1758 nt, Artificial Sequence; identical to SEQ ID NO: 210346
  derived and/or modified sequence opt5 from hemagglutinin__InfluenzaB__AGX19832

SEQ ID NO: 210374 - RNA, 1758 nt, Artificial Sequence; identical to SEQ ID NO: 210013
  derived and/or modified sequence opt5 from hemagglutinin__InfluenzaB__AGX19843

SEQ ID NO: 210375 - RNA, 1758 nt, Artificial Sequence; identical to SEQ ID NO: 210013
  derived and/or modified sequence opt5 from hemagglutinin__InfluenzaB__AGX19854

SEQ ID NO: 210376 - RNA, 1758 nt, Artificial Sequence; identical to SEQ ID NO: 210013
  derived and/or modified sequence opt5 from hemagglutinin__InfluenzaB__AGX19865

SEQ ID NO: 210377 - RNA, 1758 nt, Artificial Sequence; identical to SEQ ID NO: 210346
  derived and/or modified sequence opt5 from hemagglutinin__InfluenzaB__AGX19876

SEQ ID NO: 210378 - RNA, 1758 nt, Artificial Sequence; identical to SEQ ID NO: 210013
  derived and/or modified sequence opt5 from hemagglutinin__InfluenzaB__AGX19887

SEQ ID NO: 210379 - RNA, 1758 nt, Artificial Sequence
  derived and/or modified sequence opt5 from hemagglutinin__InfluenzaB__AGX19898
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacgaaaauggcuucuuugccacaauggcuugggccguccccaaaaacgacaagaauaaaaccgcgaccaacccucugacaaucgaggugcccuacauuuguacggagggggaagaucagaucaccguguggggauuccacagcgacaaugagacacagauggccaaacuuuauggcgauucuaagccgcagaaguuuaccuccagcgcuaacggggucacaacccacuacguuucucaaaucggaggcuucccuaaccagacggaagacggcgggcugccccaguccggaagaauugugguggauuauaugguccaaaagagcggcaaaacagggaccaucaccuaccagcggggcauucuccugccucagaagguguggugcgccucuggacgcuccaaaguuaucaaggggagccuuccccugauuggagaggcugacugucuccaugagaaauauggcggccugaauaaguccaagcccuacuacacaggggaacacgccaaagcgaucggaaacugcccuaucugggugaagaccccgcugaaacucgccaauggcacaaaguauagacccccugcuaaacugcuuaaggagcggggguuuuucggagccauugcuggcuuucuggaagggggcugggagggaaugaucgccggcuggcauggguacacgucucacggagcccacggcgucgcuguggcggccgaucucaagagcacccaggaagcuauuaacaaaaucacaaagaaucugaacucccuuagcgagcuggagguuaaaaaucuccagcgccugucuggggccauggacgaacugcauaacgagauucucgaacuggaugagaagguggacgaccuuagagccgauaccaucuccagccaaaucgaacuggcuguccuccugucuaaugagggaauuaucaacagcgaggacgaacaccuucuggcccucgagcggaaacugaagaagaugcugggccccuccgcgguggaaauugggaauggcuguuucgagacaaaacauaagugcaaccagaccugccucgaucgcaucgcugccggaacguuugacgccggcgaguucucucugccuaccuuugauagccuuaauauuacagcugccucccugaacgacgaugggcucgacaaucacaccauccugcuguauuacagcacagcugccucuucccuugcggucacccucaugauugccaucuucgugguuuauauggugagcagagauaacgucucuuguuccaucugccuguga

SEQ ID NO: 210380 - RNA, 1758 nt, Artificial Sequence; identical to SEQ ID NO: 209538
  derived and/or modified sequence opt5 from hemagglutinin__InfluenzaB__AGX19909

SEQ ID NO: 210381 - RNA, 1758 nt, Artificial Sequence; identical to SEQ ID NO: 210013
  derived and/or modified sequence opt5 from hemagglutinin__InfluenzaB__AGX19920

SEQ ID NO: 210382 - RNA, 1758 nt, Artificial Sequence; identical to SEQ ID NO: 210379
  derived and/or modified sequence opt5 from hemagglutinin__InfluenzaB__AGX19931

SEQ ID NO: 210383 - RNA, 1758 nt, Artificial Sequence; identical to SEQ ID NO: 210346
  derived and/or modified sequence opt5 from hemagglutinin__InfluenzaB__AGX19942

SEQ ID NO: 210384 - RNA, 1758 nt, Artificial Sequence; identical to SEQ ID NO: 210013
  derived and/or modified sequence opt5 from hemagglutinin__InfluenzaB__AGX19953

SEQ ID NO: 210385 - RNA, 1758 nt, Artificial Sequence; identical to SEQ ID NO: 209771
  derived and/or modified sequence opt5 from hemagglutinin__InfluenzaB__AGX19964

SEQ ID NO: 210386 - RNA, 1758 nt, Artificial Sequence; identical to SEQ ID NO: 209538
  derived and/or modified sequence opt5 from hemagglutinin__InfluenzaB__AGX19975

SEQ ID NO: 210387 - RNA, 1758 nt, Artificial Sequence
  derived and/or modified sequence opt5 from hemagglutinin__InfluenzaB__AGX19986
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcguuucugggcgcuccaaagugaucaagggaagccuuccccugauuggcgaagccgacugucuccaugagaaauauggcgggcugaauaaguccaagcccuacuacacaggagagcacgcuaaagccaucggcaacugcccuaucugggucaagaccccgcugaaacucgcgaaugggacaaaguauagacccccugccaaacugcuuaaggaacggggauuuuucggcgcuauugccggguuucuggagggcggaugggaaggcaugaucgcuggguggcauggauacacgucucacggcgcccacgggguggccguugcugcggaucucaagagcacccaggaggccauuaacaaaaucacaaagaaucugaacucccuuagcgaacuggaggugaaaaaucuccagcgccugucuggagcuauggacgagcugcauaacgaaauucucgagcuggaugaaaaggucgacgaccuuagagccgauaccaucuccagccaaaucgagcuggccgugcuccugucuaaugaaggcauuaucaacagcgaggacgagcaccuucuggcucucgaacggaaacugaagaagaugcuggggcccuccgccgucgagauuggcaauggauguuucgaaacaaaacauaagugcaaccagaccugccucgaucgcaucgcggcuggcacguuugacgccggggaguucucucugccuaccuuugauagccuuaauauuacagccgcuucccugaacgacgauggacucgacaaucacaccauccugcuguauuacagcacagccgcuucuucccuugccgugacccucaugauugcgaucuucguuguguauauggucagcagagauaacgugucuuguuccaucugccuguga

SEQ ID NO: 210388 - RNA, 1758 nt, Artificial Sequence
  derived and/or modified sequence opt5 from hemagglutinin__InfluenzaB__AGX19997
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagauugaggacgggggacugccccaguccggcagaaucgugguggauuauaugguccaaaagagcgggaaaacgggaacaauuaccuaccagcggggcauccuccugccucagaagguguggugcgccucugggcgcuccaaaguuauuaagggaagccuuccccugaucggcgaagcugacugucuccaugagaaauauggcgggcugaauaaguccaagcccuacuacaccggagagcacgccaaagcgaucggcaacugcccuauuugggugaagacaccgcugaaacucgccaaugggaccaaguauagacccccugcuaaacugcuuaaggaacggggauuuuucggcgccaucgcuggguuucuggagggcggaugggaaggcaugauugccggguggcauggauacacaucucacggcgcccacggggucgcuguggcggccgaucucaagagcacgcaggaggcuaucaacaaaauuaccaagaaucugaacucccuuagcgaacuggagguuaaaaaucuccagcgccugucuggagccauggacgagcugcauaacgaaauccucgagcuggaugaaaagguggacgaccuuagagccgauacaaucuccagccaaauugagcuggcuguccuccugucuaaugaaggcaucauuaacagcgaggacgagcaccuucuggcccucgaacggaaacugaagaagaugcuggggcccuccgcgguggagaucggcaauggauguuucgaaaccaaacauaagugcaaccagacaugccucgaucgcauugcugccggcaccuuugacgccggggaguucucucugccuacguuugauagccuuaauaucaccgcugccucccugaacgacgauggacucgacaaucacacaauucugcuguauuacagcaccgcugccucuucccuugcggucacacucaugaucgccaucuucgugguuuauauggugagcagagauaacgucucuuguuccauuugccuguga

SEQ ID NO: 210389 - RNA, 1758 nt, Artificial Sequence; identical to SEQ ID NO: 210013
  derived and/or modified sequence opt5 from hemagglutinin__InfluenzaB__AGX20008

SEQ ID NO: 210390 - RNA, 1758 nt, Artificial Sequence; identical to SEQ ID NO: 210013
  derived and/or modified sequence opt5 from hemagglutinin__InfluenzaB__AGX20019

SEQ ID NO: 210391 - RNA, 1758 nt, Artificial Sequence; identical to SEQ ID NO: 210013
  derived and/or modified sequence opt5 from hemagglutinin__InfluenzaB__AGX20030

SEQ ID NO: 210392 - RNA, 1758 nt, Artificial Sequence
  derived and/or modified sequence opt5 from hemagglutinin__InfluenzaB__AGX20041
augaaggccaucauugugcugcucauggucguuaccagcgacgcugauagaaucugcacaggcauuacguccucuaacagcccccacguggugaaaaccgccacacagggggaggucaaugugaccggaguuaucccucugacaaccacaccgaccaagucccauuucgcgaaccuuaaaggcaaggaaacgcgggggaaacugugucccaagugccucaauuguaccgaccuggauguggcucuuggacgcccuaagugcacaggcaaaauucccucugccagagucagcauccugcacgaggugcggccuguuaccuccggguguuuucccaucaugcaugaccgcacaaagauuagacaacucccuaaccugcugcggggauacgaacacauccgccucucuacccauaaugugauuaacgccgagaaugcuccgggcggccccuauaaaaucgggacgagcggauccugcccuaacauuacaaauggcaacggguucuuugccaccauggcuugggccguccccaagaaugauaaaaacaagacagcgaccaauccucugaccaucgaagugcccuacauuuguacagagggagaggaccagaucacgguguggggcuuccacagcgauaacgaaacccagauggccaagcuguauggggacucuaaaccgcagaaguuuacauccagcgcuaauggagucaccacacacuacguuucucaaaucggcggcuucccuaaccagaccgaggaugggggacugccccaguccggcagaauugugguggacuauaugguccagaaaagcgggaagacgggaacaaucaccuaccaacggggcauucuccugccucagaaaguguggugcgccucugggcgcuccaagguuaucaaaggaagccuuccccugauuggcgaagcugauugucuccaugagaaguauggcgggcugaacaaguccaaacccuacuacaccggagagcacgccaaggcgaucggcaauugcccuaucugggugaaaacaccgcugaagcucgccaacgggaccaaauauagacccccugcuaagcugcuuaaggaacggggauuuuucggcgccauugcuggguuucuggagggcggaugggaaggcaugaucgccggguggcauggauacacaucucacggcgcccacggggucgcuguggcggccgaccucaaaagcacgcaggaggcuauuaauaagaucaccaaaaaccuuaauucccuuagcgaacuggagguuaagaaccuccagcgccugucuggagccauggaugagcugcauaaugaaauucucgagcuggacgaaaaaguggacgaucuuagagccgacacaaucuccagccaaaucgagcuggcuguccuccugucuaacgaaggcauuaucaauagcgaggaugagcaccuucuggcccucgaacggaagcugaagaaaaugcuggggcccuccgcgguggagauuggcaacggauguuucgaaaccaagcauaaaugcaaucagacaugccucgaccgcaucgcugccggcaccuuugaugccggggaguucucucugccuacguuugacagccuuaacauuaccgcugccucccugaaugaugacggacucgauaaccacacaauccugcuguauuacagcaccgcugccucuucccuugcggucacacucaugauugccaucuucgugguuuauauggugagcagagacaaugucucuuguuccaucugccuguga

SEQ ID NO: 210393 - RNA, 1758 nt, Artificial Sequence; identical to SEQ ID NO: 210013
  derived and/or modified sequence opt5 from hemagglutinin__InfluenzaB__AGX20052

SEQ ID NO: 210394 - RNA, 1758 nt, Artificial Sequence; identical to SEQ ID NO: 210013
  derived and/or modified sequence opt5 from hemagglutinin__InfluenzaB__AGX20063

SEQ ID NO: 210395 - RNA, 1758 nt, Artificial Sequence
  derived and/or modified sequence opt5 from hemagglutinin__InfluenzaB__AGX20074
augaaggccaucauugcucugcucaugguggucaccagcaacgccgacagaaucugcacaggcauuacguccucuaauagcccccacguugugaaaaccgcgacacagggggaggugaacgucaccggagugaucccucugacaaccacaccgaccaagucccauuucgcuaaucuuaaaggcacggaaacccgggggaagcugugucccaaaugccucaacuguacagaucuggacguugcccuuggacgcccuaagugcaccggcaagauucccucugccagagugagcauccugcacgagguccggccugugacauccggguguuuucccaucaugcaugaucgcaccaaaauuagacaacucccuaaucugcugcggggauacgaacacauccgccucucuacgcauaacguuauuaaugcugagaacgccccgggcggccccuauaagaucgggacaagcggauccugcccuaauauuaccaacggcaauggguucuuugcuacaauggccugggcggugcccaaaaacgacaagaauaaaaccgccaccaacccucugacaaucgaaguccccuacauuuguacggagggagaggaucagaucaccguguggggcuuccacagcgacaaugaaacacagauggcuaaacuuuauggggauucuaagccgcagaaguuuaccuccagcgccaacggagugacaacccacuacgucucucaaaucggcggcuucccuaaccagacggaggacgggggacugccccaguccggcagaauuguuguggauuauauggugcaaaagagcgggaaaacaggaaccaucaccuaccagcggggcauucuccugccucagaaggucuggugcgcuucugggcgcuccaaagugaucaagggaagccuuccccugauuggcgaagccgacugucuccaugagaaauauggcgggcugaauaaguccaagcccuacuacacaggagagcacgcgaaagccaucggcaacugcccuaucuggguuaagaccccgcugaaacucgcuaaugggacaaaguauagacccccugccaaacugcuuaaggaacggggauuuuucggcgcuauugccggguuucuggagggcggaugggaaggcaugaucgccggguggcauggauacacgucucacggcgcucacgggguggcggucgccgcugaucucaagagcacccaggaggccauuaacaaaaucacaaagaaucugaacucccuuagcgaacuggaggugaaaaaucuccagcgccugucuggagccauggacgagcugcauaacgaaauucucgagcuggaugaaaagguugacgaccuuagagcugauaccaucuccagccaaaucgagcuggccgugcuccugucuaaugaaggcauuaucaacagcgaggacgagcaccuucuggcgcucgaacggaaacugaagaagaugcuggggcccuccgcugucgagauuggcaauggauguuucgaaacaaaacauaagugcaaccagaccugccucgaucgcaucgccgccggcacguuugacgcuggggaguucucucugccuaccuuugauagccuuaauauuacagccgcuucccugaacgacgauggacucgacaaucacaccauccugcuguauuacagcacagccgcgucuucccuugccgugacccucaugauugcuaucuucgucguguauaugguuagcagagauaacgugucuuguuccaucugccuguga

SEQ ID NO: 210396 - RNA, 1758 nt, Artificial Sequence
  derived and/or modified sequence opt5 from hemagglutinin__InfluenzaB__AGX20085
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccaucuggggcuuccacagcgacaaugaaacacagauggccaaacuuuauggggauucuaagccgcagaaguuuaccuccagcgcuaacggagugacaacccacuacgucucucaaauuggcggcuucccuaaccagacggaggacgggggacugccccaguccggcagaaucguuguggauuauauggugcaaaagagcgggaaaacaggaaccauuaccuaccagcggggcauccuccugccucagaaggucuggugcgccucugggcgcuccaaagugauuaagggaagccuuccccugaucggcgaagcugacugucuccaugagaaauauggcgggcugaauaaguccaagcccuacuacacaggagagcacgccaaagcgaucggcaacugcccuauuuggguuaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcugucgcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaagguugacgaccuuagagccgauaccaucuccagccaaauugagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccaucuucgucguguauaugguuagcagagauaacgugucuuguuccauuugccuguga

SEQ ID NO: 210397 - RNA, 1758 nt, Artificial Sequence
  derived and/or modified sequence opt5 from hemagglutinin__InfluenzaB__AGX20096
augaaggccaucauugugcugcucauggucguuaccagcaacgcugacagaaucugcacaggcgugacguccucuaauagcccccacguggucaaaaccgccacacagggggaggugaacguuaccggagugauuccucugacaaccacaccgaccaagucccauuucgcgaaucuuaaaggcacggaaacccgggggaagcugugucccaaaugccucaacuguacagaucuggacgucgcucuuggacgcccuaagugcaccggcaauauccccucugccagagugagcauucugcacgagguucggccugugacauccggguguuuucccaucaugcaugaucgcaccaagaucagacaacucccuaaccugcugcggggauacgaacacauucgccucucuacgcauaaugucaucaacgccgagaaugcuccgggcggccccuauaaaauugggacaagcggauccugcccuaacgugaccaauggcaacggguucuuugccacaauggcuugggccgugcccaagaaugacaacaauaaaaccgcgaccaacagccugacaaucgaagucccuuacauuuguacggagggagaggaucagaucaccguuuggggcuuccacucugacaacgaaacacagauggccaaacuuuauggggauuccaagccccagaaguuuaccagcucugcuaauggagugacaacccacuacgugucccaaauuggcggcuucccgaaccagacggaggacgggggacugccucagagcggcagaaucgucguggauuauaugguucagaagucugggaaaacaggaaccaucaccuaccaacggggcauucuccugccccagaagguguggugcgccuccgggcgcagcaaagucaucaagggaucccuuccucugauuggcgaagcugacugucuccaugagaaauauggcgggcugaauaagucuaaacccuacuacacaggagagcacgccaaggcgaucggcaacugccccauuugggugaagaccccucugaaacucgccaaugggacaaaguauagaccgcccgcuaaacugcuuaaggaacggggauuuuucggcgccaucgcuggguuucuggagggcggaugggaaggcaugaucgccggguggcauggauacacgagccacggcgcccacgggguugcuguggcggccgaucucaaauccacccaggaggcuauuaacaagaucacaaagaaucugaacagccuuucugaacuggaggucaaaaaucuccagcgccuguccggagccauggacgagcugcauaacgaaauucucgagcuggaugaaaagguggacgaccuuagagccgauaccaucagcucucaaauugagcuggcuguccuccugagcaaugaaggcaucaucaacuccgaggacgagcaccuucuggcccucgaacggaaacugaagaaaaugcuggggccuucugcgguggagauuggcaauggauguuucgaaacaaagcauaagugcaaccagaccugccucgaucgcaucgcugccggcacguuugacgccggggaguucagccugcccaccuuugauucccuuaauauuacagcugccagccugaacgacgauggacucgacaaccacaccauccugcuguauuacucuacagcugccuccagccuugcgguuacccucaugauugccaucuucguggucuauauggugucuagagauaauguuuccuguagcauuugccuguga

SEQ ID NO: 210398 - RNA, 1758 nt, Artificial Sequence; identical to SEQ ID NO: 209632
  derived and/or modified sequence opt5 from hemagglutinin__InfluenzaB__AGX20107

SEQ ID NO: 210399 - RNA, 1758 nt, Artificial Sequence; identical to SEQ ID NO: 209632
  derived and/or modified sequence opt5 from hemagglutinin__InfluenzaB__AGX20118

SEQ ID NO: 210400 - RNA, 1758 nt, Artificial Sequence; identical to SEQ ID NO: 209632
  derived and/or modified sequence opt5 from hemagglutinin__InfluenzaB__AGX20129

SEQ ID NO: 210401 - RNA, 1758 nt, Artificial Sequence; identical to SEQ ID NO: 209632
  derived and/or modified sequence opt5 from hemagglutinin__InfluenzaB__AGX20140

SEQ ID NO: 210402 - RNA, 1758 nt, Artificial Sequence; identical to SEQ ID NO: 209632
  derived and/or modified sequence opt5 from hemagglutinin__InfluenzaB__AGX20151

SEQ ID NO: 210403 - RNA, 1758 nt, Artificial Sequence; identical to SEQ ID NO: 209632
  derived and/or modified sequence opt5 from hemagglutinin__InfluenzaB__AGX20162

SEQ ID NO: 210404 - RNA, 1758 nt, Artificial Sequence; identical to SEQ ID NO: 209632
  derived and/or modified sequence opt5 from hemagglutinin__InfluenzaB__AGX20173

SEQ ID NO: 210405 - RNA, 1758 nt, Artificial Sequence; identical to SEQ ID NO: 209632
  derived and/or modified sequence opt5 from hemagglutinin__InfluenzaB__AGX20184

SEQ ID NO: 210406 - RNA, 1758 nt, Artificial Sequence; identical to SEQ ID NO: 209632
  derived and/or modified sequence opt5 from hemagglutinin__InfluenzaB__AGX20195

SEQ ID NO: 210407 - RNA, 1758 nt, Artificial Sequence; identical to SEQ ID NO: 209632
  derived and/or modified sequence opt5 from hemagglutinin__InfluenzaB__AGX20206

SEQ ID NO: 210408 - RNA, 1758 nt, Artificial Sequence; identical to SEQ ID NO: 209632
  derived and/or modified sequence opt5 from hemagglutinin__InfluenzaB__AGX20217

SEQ ID NO: 210409 - RNA, 1758 nt, Artificial Sequence; identical to SEQ ID NO: 209669
  derived and/or modified sequence opt5 from hemagglutinin__InfluenzaB__AGX20228

SEQ ID NO: 210410 - RNA, 1758 nt, Artificial Sequence
  derived and/or modified sequence opt5 from hemagglutinin__InfluenzaB__AGX20239
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaucgucuggggcuuccacagcgacaaugaaacccagauggccaagcuguauggggauucuaagccucagaaauuuacauccagcgcuaacggaguuaccacacacuacgugucucaaaucggcggcuuccccaaccagaccgaggacgggggacuuccucaguccggcagaauuguggucgauuauauggugcaaaagagcgggaaaacgggaacaaucaccuaccagcggggcauucugcucccccagaagguuuggugcgccucugggcgcuccaaagugaucaagggaagccugccccuuauuggcgaagcugacugucugcaugagaaauauggcgggcucaauaaguccaagccuuacuacaccggagagcacgccaaagcgaucggcaacugcccgaucugggucaagacaccccugaaacuggccaaugggaccaaguauagaccucccgcuaaacuccugaaggaacggggauuuuucggcgccauugcuggguuucuugagggcggaugggaaggcaugaucgccggguggcauggauacacaucucacggcgcccacgggguggcuguugcggccgaucucaagagcacgcaggaggcuauuaacaaaaucaccaagaaucugaacucccugagcgaacuugaggugaaaaaucugcagcgccucucuggagccauggacgagcugcauaacgaaauucuggagcucgaugaaaaggucgacgaccugagagccgauacaaucuccagccaaaucgagcuugcugugcugcucucuaaugaaggcauuaucaacagcgaggacgagcaucugcuugcccuggaacggaaacucaagaagaugcuggggccuuccgcggucgagauuggcaauggauguuucgaaaccaaacacaagugcaaccagacaugccuggaucgcaucgcugccggcaccuuugacgccggggaguucucucuccccacguuugauagccugaauauuaccgcugccucccuuaacgacgauggacuggacaaucacacaauccuccuguauuacagcaccgcugccucuucccuggcggugacacuuaugauugccaucuucguuguguauauggucagcagagauaacgugucuuguuccaucugccucuga

SEQ ID NO: 210411 - RNA, 1758 nt, Artificial Sequence; identical to SEQ ID NO: 209632
  derived and/or modified sequence opt5 from hemagglutinin__InfluenzaB__AGX20250

SEQ ID NO: 210412 - RNA, 1758 nt, Artificial Sequence; identical to SEQ ID NO: 209632
  derived and/or modified sequence opt5 from hemagglutinin__InfluenzaB__AGX20261

SEQ ID NO: 210413 - RNA, 1758 nt, Artificial Sequence; identical to SEQ ID NO: 209632
  derived and/or modified sequence opt5 from hemagglutinin__InfluenzaB__AGX20272

SEQ ID NO: 210414 - RNA, 1758 nt, Artificial Sequence; identical to SEQ ID NO: 209632
  derived and/or modified sequence opt5 from hemagglutinin__InfluenzaB__AGX20283

SEQ ID NO: 210415 - RNA, 1758 nt, Artificial Sequence; identical to SEQ ID NO: 209632
  derived and/or modified sequence opt5 from hemagglutinin__InfluenzaB__AGX20294

SEQ ID NO: 210416 - RNA, 1758 nt, Artificial Sequence
  derived and/or modified sequence opt5 from hemagglutinin__InfluenzaB__AGX20305
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaaccagcucacaauugaagugcccuacaucuguacggagggagaggaucagauuaccgucuggggcuuccacagcgacaaugaaacacagauggccaagcuguauggggauucuaagccgcaaaaauuuaccuccagcgcuaacggaguuacaacccacuacgugucucagaucggcggcuucccuaaccagacggaggacgggggacuuccccaguccggcagaaucguggucgauuauauggugcaaaagagcgggaaaacaggaaccauuaccuaccagcggggcauccugcucccucagaagguuuggugcgccucugggcgcuccaaagugauuaagggaagccugccccuuaucggcgaagcugacugucugcaugagaaauauggcgggcucaauaaguccaagcccuacuacacaggagagcacgccaaagcgauuggcaacugcccuaucugggucaagaccccgcugaaacuggccaaugggacaaaguauagacccccugcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcaacgccucucuggagccauggacgagcugcauaacgaaauccuggagcucgaugaaaaggucgacgaccugagagccgauaccauuuccagccagaucgagcuugcugugcugcucucuaaugaaggcaucauuaacagcgaggacgagcaucugcuugcccuggaacggaaacucaagaagaugcuggggcccuccgcggucgagaucggcaauggauguuucgaaacaaaacacaagugcaaccagaccugccuggaucgcauugcugccggcacguuugacgccggggaguucucucucccuaccuuugauagccugaauaucacagcugccucccuuaacgacgauggacuggacaaucacaccauucuccuguauuacagcacagcugccucuucccuggcggugacccuuaugaucgccauuuucguuguguauauggucagcagagauaacgugucuuguuccaucugccucuga

SEQ ID NO: 210417 - RNA, 1758 nt, Artificial Sequence; identical to SEQ ID NO: 209632
  derived and/or modified sequence opt5 from hemagglutinin__InfluenzaB__AGX20316

SEQ ID NO: 210418 - RNA, 1758 nt, Artificial Sequence; identical to SEQ ID NO: 209632
  derived and/or modified sequence opt5 from hemagglutinin__InfluenzaB__AGX20327

SEQ ID NO: 210419 - RNA, 1758 nt, Artificial Sequence
  derived and/or modified sequence opt5 from hemagglutinin__InfluenzaB__AGX20338
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaaccuguauggggauucuaagccucagaaguuuaccuccagcgcuaacggaguuacaacccacuacgugucucaaaucggcggcuuccccaaucagacggaggacgggggacuuccucaguccggcagaaucguggucgauuauauggugcagaaaagcgggaagacaggaaccauuaccuaccaacggggcauccugcucccccagaaaguuuggugcgccucugggcgcuccaaggugauuaaaggaagccugccccuuaucggcgaagcugacugucugcaugagaaguauggcgggcucaacaaauccaagccuuacuacacaggagagcacgccaaggcgauuggcaauugcccgaucugggucaaaacaccccugaagcuggccaacgggacaaaauauagaccucccgcuaagcuccugaaagaacggggauuuuucggcgccaucgcuggguuucuugagggcggaugggaaggcaugauugccggguggcauggauacacgucucacggcgcccacgggguggcuguugcggccgaucugaaaagcacccaggaggcuaucaauaagauuaccaagaaccucaauucccugagcgaacuugaggugaagaaccugcagcgccucucuggagccauggacgagcugcauaaugaaauccuggagcucgaugaaaaagucgacgaccugagagccgauaccauuuccagccaaaucgagcuugcugugcugcucucuaacgaaggcaucauuaauagcgaggacgagcaucugcuugcccuggaacggaagcucaaaaagaugcuggggccuuccgcggucgagaucggcaacggauguuucgaaacaaagcacaaaugcaaucagaccugccuggaucgcauugcugccggcacguuugacgccggggaguucucucuccccaccuuugauagccugaacaucacagcugccucccuuaaugacgauggacuggacaaccacaccauucuccuguauuacagcacagcugccucuucccuggcggugacccuuaugaucgccauuuucguuguguauauggucagcagagauaacgugucuuguuccaucugccucuga

SEQ ID NO: 210420 - RNA, 1758 nt, Artificial Sequence; identical to SEQ ID NO: 209632
  derived and/or modified sequence opt5 from hemagglutinin__InfluenzaB__AGX20349

SEQ ID NO: 210421 - RNA, 1758 nt, Artificial Sequence; identical to SEQ ID NO: 209632
  derived and/or modified sequence opt5 from hemagglutinin__InfluenzaB__AGX20360

SEQ ID NO: 210422 - RNA, 1758 nt, Artificial Sequence; identical to SEQ ID NO: 209669
  derived and/or modified sequence opt5 from hemagglutinin__InfluenzaB__AGX20371

SEQ ID NO: 210423 - RNA, 1758 nt, Artificial Sequence
  derived and/or modified sequence opt5 from hemagglutinin__InfluenzaB__AGX20382
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccaugaacgagcugcauaaugaaauccuggagcucgacgaaaaggucgaugaccugagagccgacaccauuuccagccaaaucgagcuugcugugcugcucucuaacgaaggcaucauuaauagcgaggaugagcaucugcuugcccuggaacggaaacucaagaagaugcuggggccuuccgcggucgagaucggcaacggauguuucgaaacaaaacacaagugcaaucagaccugccuggaccgcauugcugccggcacguuugaugccggggaguucucucuccccaccuuugacagccugaacaucacagcugccucccuuaaugaugacggacuggauaaccacaccauucuccuguauuacagcacagcugccucuucccuggcggugacccuuaugaucgccauuuucguuguguauauggucagcagagacaacgugucuuguuccaucugccucuga

SEQ ID NO: 210424 - RNA, 1758 nt, Artificial Sequence; identical to SEQ ID NO: 209632
  derived and/or modified sequence opt5 from hemagglutinin__InfluenzaB__AGX20393

SEQ ID NO: 210425 - RNA, 1758 nt, Artificial Sequence; identical to SEQ ID NO: 209669
  derived and/or modified sequence opt5 from hemagglutinin__InfluenzaB__AGX20404

SEQ ID NO: 210426 - RNA, 1758 nt, Artificial Sequence; identical to SEQ ID NO: 209632
  derived and/or modified sequence opt5 from hemagglutinin__InfluenzaB__AGX20415

SEQ ID NO: 210427 - RNA, 1758 nt, Artificial Sequence; identical to SEQ ID NO: 209632
  derived and/or modified sequence opt5 from hemagglutinin__InfluenzaB__AGX20426

SEQ ID NO: 210428 - RNA, 1758 nt, Artificial Sequence; identical to SEQ ID NO: 209632
  derived and/or modified sequence opt5 from hemagglutinin__InfluenzaB__AGX20437

SEQ ID NO: 210429 - RNA, 1758 nt, Artificial Sequence; identical to SEQ ID NO: 209632
  derived and/or modified sequence opt5 from hemagglutinin__InfluenzaB__AGX20448

SEQ ID NO: 210430 - RNA, 1758 nt, Artificial Sequence; identical to SEQ ID NO: 209632
  derived and/or modified sequence opt5 from hemagglutinin__InfluenzaB__AGX20459

SEQ ID NO: 210431 - RNA, 1758 nt, Artificial Sequence; identical to SEQ ID NO: 209632
  derived and/or modified sequence opt5 from hemagglutinin__InfluenzaB__AGX20470

SEQ ID NO: 210432 - RNA, 1758 nt, Artificial Sequence; identical to SEQ ID NO: 209632
  derived and/or modified sequence opt5 from hemagglutinin__InfluenzaB__AGX20481

SEQ ID NO: 210433 - RNA, 1758 nt, Artificial Sequence; identical to SEQ ID NO: 209632
  derived and/or modified sequence opt5 from hemagglutinin__InfluenzaB__AGX20492

SEQ ID NO: 210434 - RNA, 1758 nt, Artificial Sequence; identical to SEQ ID NO: 209632
  derived and/or modified sequence opt5 from hemagglutinin__InfluenzaB__AGX20503

SEQ ID NO: 210435 - RNA, 1758 nt, Artificial Sequence; identical to SEQ ID NO: 209632
  derived and/or modified sequence opt5 from hemagglutinin__InfluenzaB__AGX20514

SEQ ID NO: 210436 - RNA, 1758 nt, Artificial Sequence
  derived and/or modified sequence opt5 from hemagglutinin__InfluenzaB__AGX20525
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucucuaaucuuaaaggcacggaaacccgggggaagcugugucccaaaugcccuaacuguacagaucucgacguggcgcugggacgccccaagugcaccggcaagauuccuagcgcuagagucuccauccuucacgaggugcggcccguuacaucuggguguuuuccuaucaugcaugaucgcaccaaaauuagacaacugccgaaucuccugcggggauacgaacacauccgccugagcacgcauaacgugauuaaugccgagaacgcccccggcggcccuuauaagaucgggacauccggaagcugccccaaugucaccaacggcaauggguucuuugcuacaauggccugggcugugccuaaaaacgacaagaauaaaaccgccaccaacccccucacaauugaagugccguacaucuguacggagggagaggaucagauuaccgucuggggcuuccacucugacaaugaaacacagauggcgaagcuguauggggauuccaagccucagaaauuuaccagcucugccaacggaguuacaacccacuacgugucccaaaucggcggcuuccccaaccagacggaggacgggggacuuccucagagcggcagaaucguggucgauuauauggugcagaagucugggaaaacaggaaccauuaccuaccaacggggcauccugcucccccagaagguuuggugcgcuuccgggcgcagcaaagugauuaagggaucccugccccuuaucggcgaagccgacugucugcaugagaaauauggcgggcucaauaagucuaagccuuacuacacaggagagcacgcuaaagccauuggcaacugcccgaucugggucaagacaccccugaaacuggcgaaugggaccaaguauagaccucccgccaaacuccugaaggaacggggauuuuucggcgcuaucgccggguuucuugagggcggaugggaaggcaugauugcuggguggcauggauacacgagccacggcgcccacgggguggccguugcugcggaucugaaguccacccaggaggccaucaacaaaauuacaaagaaucucaacagccugucugaacuugaggugaaaaaucugcagcgccucuccggagcuauggacgagcugcauaacgaaauccuggagcucgaugaaaaggucgacgaccugagagccgauaccauuagcucucaaaucgagcuugccgugcugcucagcaaugaaggcaucauuaacuccgaggacgagcaucugcuugcucuggaacggaaacucaagaagaugcuggggccuucugccgucgagaucggcaauggauguuucgaaacaaaacacaagugcaaccagaccugccuggaucgcauugcggcuggcacguuugacgccggggaguucagccuccccaccuuugauucccugaauaucacagccgcuagccuuaacgacgauggacuggacaaucacaccauucuccuguauuacucuacagccgcuuccagccuggccgugacccuuaugaucgcgauuuucguuguguauauggucucuagagauaacguguccuguagcaucugccucuga

SEQ ID NO: 210437 - RNA, 1758 nt, Artificial Sequence; identical to SEQ ID NO: 209632
  derived and/or modified sequence opt5 from hemagglutinin__InfluenzaB__AGX20536

SEQ ID NO: 210438 - RNA, 1758 nt, Artificial Sequence
  derived and/or modified sequence opt5 from hemagglutinin__InfluenzaB__AGX20547
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccaccaugugucucaaaucggcggcuucccuaaccagacggaggacgggggacugccccaguccggcagaaucguggucgauuacauggugcaaaagagcgggaaaacaggaaccauuaccuaucagcggggcauccuccugccucagaagguuuggugcgccucugggcgcuccaaagugauuaagggaagccuuccccugaucggcgaagcugacugucuccacgagaaauacggcgggcugaauaaguccaagcccuauuacacaggagagcaugccaaagcgauuggcaacugcccuaucugggucaagaccccgcugaaacucgccaaugggacaaaguacagacccccugcuaaacugcuuaaggaacggggauuuuucggcgccaucgcuggguuucuggagggcggaugggaaggcaugauugccggguggcacggauauacgucucacggcgcccaugggguggcuguugcggccgaucucaagagcacccaggaggcuaucaacaaaauuacaaagaaucugaacucccuuagcgaacuggagaucaaaaaucuccagcgccugucuggagccauggacgagcugcacaacgaaauucucgagcuggaugaaaagguggacgaccuuagagccgauaccaucuccagccaaaucgagcuggcuguccuccugucuaaugaaggcauuaucaacagcgaggacgagcaucuucuggcccucgaacggaaacugaagaagaugcuggggcccuccgcgguggagauuggcaauggauguuucgaaacaaaacacaagugcaaccagaccugccucgaucgcaucgcugccggcacguuugacgccggggaguucucucugccuaccuuugauagccuuaauauuacagcugccucccugaacgacgauggacucgacaaucauaccauccugcuguacuauagcacagcugccucuucccuugcggucacccucaugauugccaucuucgugguuuacauggugagcagagauaacgucucuuguuccaucugccuguga

SEQ ID NO: 210439 - RNA, 1758 nt, Artificial Sequence; identical to SEQ ID NO: 209686
  derived and/or modified sequence opt5 from hemagglutinin__InfluenzaB__AGX20558

SEQ ID NO: 210440 - RNA, 1758 nt, Artificial Sequence; identical to SEQ ID NO: 209632
  derived and/or modified sequence opt5 from hemagglutinin__InfluenzaB__AGX20569

SEQ ID NO: 210441 - RNA, 1758 nt, Artificial Sequence; identical to SEQ ID NO: 209669
  derived and/or modified sequence opt5 from hemagglutinin__InfluenzaB__AGX20580

SEQ ID NO: 210442 - RNA, 1758 nt, Artificial Sequence; identical to SEQ ID NO: 209632
  derived and/or modified sequence opt5 from hemagglutinin__InfluenzaB__AGX20591

SEQ ID NO: 210443 - RNA, 1758 nt, Artificial Sequence; identical to SEQ ID NO: 209632
  derived and/or modified sequence opt5 from hemagglutinin__InfluenzaB__AGX20602

SEQ ID NO: 210444 - RNA, 1758 nt, Artificial Sequence; identical to SEQ ID NO: 209632
  derived and/or modified sequence opt5 from hemagglutinin__InfluenzaB__AGX20613

SEQ ID NO: 210445 - RNA, 1758 nt, Artificial Sequence; identical to SEQ ID NO: 209632
  derived and/or modified sequence opt5 from hemagglutinin__InfluenzaB__AGX20624

SEQ ID NO: 210446 - RNA, 1758 nt, Artificial Sequence
  derived and/or modified sequence opt5 from hemagglutinin__InfluenzaB__AGX20635
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacuuauggccaagcuguauggggauucuaagccgcagaaauuuaccuccagcgcuaacggaguuacaacccacuacgugucucagaucggcggcuucccuaaccaaacggaggacgggggacucccccaguccggcagaaucguggucgauuauauggugcaaaagagcgggaaaacaggaaccauuaccuaccagcggggcauccugcuuccucagaagguuuggugcgccucugggcgcuccaaagugauuaagggaagccugccccucaucggcgaagcugacugucugcaugagaaauauggcgggcugaauaaguccaagcccuacuacacaggagagcacgccaaagcgauuggcaacugcccuaucugggucaagaccccgcucaaacuggccaaugggacaaaguauagacccccugcuaaacuucugaaggaacggggauuuuucggcgccaucgcuggguuucucgagggcggaugggaaggcaugauugccggguggcauggauacacgucucacggcgcccacgggguggcuguugcggccgaucuuaagagcacccaggaggcuaucaacaaaauuacaaagaaucugaacucccugagcgaacucgaggugaaaaaucugcagcgccugucuggagccauggacgagcuccauaacgaaauccuggagcuugaugaaaaggucgacgaccugagagccgauaccauuuccagccagaucgagcucgcugugcugcuuucuaaugaaggcaucauuaacagcgaggacgagcaucugcucgcccuggaacggaaacugaagaagaugcucgggcccuccgcggucgagaucggcaauggauguuucgaaacaaaacacaagugcaaccaaaccugccuggaucgcauugcugccggcacguuugacgccggggaguucucucuuccuaccuuugauagccugaauaucacagcugccucccucaacgacgauggacuggacaaucacaccauucugcuuuauuacagcacagcugccucuucccucgcggugacccugaugaucgccauuuucguuguguauauggucagcagagauaacgugucuuguuccaucugccuguga

SEQ ID NO: 210447 - RNA, 1758 nt, Artificial Sequence; identical to SEQ ID NO: 209632
  derived and/or modified sequence opt5 from hemagglutinin__InfluenzaB__AGX20646

SEQ ID NO: 210448 - RNA, 1758 nt, Artificial Sequence
  derived and/or modified sequence opt5 from hemagglutinin__InfluenzaB__AGX20668
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaccaaaaccgcgacaaauccccucacgauugaagugccguacaucuguaccgagggagaggaucagauuacagucuggggcuuccacagcgacaacgaaacccagauggccaagcuguauggggauucuaagccucagaaauuuacauccagcgcuaauggaguuaccacgcacuacgugucucaaaucggcggcuuccccaaccagacagaggacgggggacuuccucaguccggcagaaucguggucgauuauauggugcaaaagagcgggaaaaccggaaccauuacauaccagcggggcauccugcucccccagaagguuuggugcgccucugggcgcuccaaagugauuaagggaagccugccccuuaucggcgaagcugacugucugcaugagaaauauggcgggcucaacaaguccaagccuuacuacaccggagagcacgccaaagcgauuggcaauugcccgaucugggucaagacaccccugaaacuggccaacgggacgaaguauagaccucccgcuaaacuccugaaggaacggggauuuuucggcgccaucgcuggguuucuugagggcggaugggaaggcaugauugccggguggcauggauacaccucucacggcgcccacgggguggcuguugcggccgaucugaaaagcacacaggaggcuaucaauaagauuaccaagaaccucaauucccugagcgaacuugaggugaaaaaccugcagcgccucucuggagccauggacgagcugcauaaugaaauccuggagcucgaugaaaaggucgacgaccugagagccgauacaauuuccagccaaaucgagcuugcugugcugcucucuaacgaaggcaucauuaauagcgaggacgagcaucugcuugcccuggaacggaaacucaagaagaugcuggggccuuccgcggucgagaucggcaacggauguuucgaaaccaaacacaagugcaaucagacgugccuggaucgcauugcugccggcaccuuugacgccggggaguucucucuccccacauuugauagccugaacaucaccgcugccucccuuaaugacgauggacuggacaaccacacaauucuccuguauuacagcaccgcugccucuucccuggcggugacgcuuaugaucgccauuuucguuguguauauggucagcagagauaaugugucuuguuccaucugccucuga

SEQ ID NO: 210449 - RNA, 1758 nt, Artificial Sequence; identical to SEQ ID NO: 209707
  derived and/or modified sequence opt5 from hemagglutinin__InfluenzaB__AGX20679

SEQ ID NO: 210450 - RNA, 1758 nt, Artificial Sequence; identical to SEQ ID NO: 209669
  derived and/or modified sequence opt5 from hemagglutinin__InfluenzaB__AGX20690

SEQ ID NO: 210451 - RNA, 1758 nt, Artificial Sequence; identical to SEQ ID NO: 209669
  derived and/or modified sequence opt5 from hemagglutinin__InfluenzaB__AGX20701

SEQ ID NO: 210452 - RNA, 1758 nt, Artificial Sequence; identical to SEQ ID NO: 210013
  derived and/or modified sequence opt5 from hemagglutinin__InfluenzaB__AGX20712

SEQ ID NO: 210453 - RNA, 1758 nt, Artificial Sequence; identical to SEQ ID NO: 209632
  derived and/or modified sequence opt5 from hemagglutinin__InfluenzaB__AGX20723

SEQ ID NO: 210454 - RNA, 1758 nt, Artificial Sequence
  derived and/or modified sequence opt5 from hemagglutinin__InfluenzaB__AGX20734
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgaacaaugugauuaacgccgagaaugcuccgggcggccccuauaagaucgggacaagcggauccugcccuaacgucaccaauggcaacggguucuuugccacaauggcuugggccgugcccaaaaaugacaagaacaaaaccgcgaccaauccucugacaauugaagugcccuacaucuguacggagggagaggaucagauuaccgucuggggcuuccauagcgacaacgaaacacagauggccaagcuguauggggauucuaagccgcagaaauuuaccuccagcgcuaacggaguuacaacccacuacgugucucaaaucggcggcuucccuaaucagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccacgagaaauauggcgggcugaacaaguccaagcccuacuacacaggagagcaugccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcacggauacacgucucauggcgcccacgggguggcuguugcggccgaucucaagagcacccaggaggcuaucaauaaaauuacaaagaaccuuaauucccuuagcgaacuggaggugaaaaaccuccagcgccugucuggagccauggacgagcugcacaaugaaauccucgagcuggaugaaaaggucgacgaccuuagagccgauaccauuuccagccaaaucgagcuggcugugcuccugucuaacgaaggcaucauuaauagcgaggacgagcaucuucuggcccucgaacggaaacugaagaagaugcuggggcccuccgcggucgagaucggcaacggauguuucgaaacaaaacacaagugcaaucagaccugccucgaucgcauugcugccggcacguuugacgccggggaguucucucugccuaccuuugauagccuuaacaucacagcugccucccugaaugacgauggacucgacaaccauaccauucugcuguauuacagcacagcugccucuucccuugcggugacccucaugaucgccauuuucguuguguauauggucagcagagauaacgugucuuguuccaucugccuguga

SEQ ID NO: 210455 - RNA, 1758 nt, Artificial Sequence
  derived and/or modified sequence opt5 from hemagglutinin__InfluenzaB__AGX20745
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccaucuggggcuuccacagcgacaaugaaacacagauggccaagcuguauggggauucuaagccucagaaauuuaccuccagcgcuaacggagucacaacccacuacguuucucaaaucggcggcuuccccaaccagacggaggacgggggacuuccucaguccggcagaauugugguggauuauaugguccaaaagagcgggaaaacaggaaccaucaccuaccagcggggcauucugcucccccagaagguguggugcgccucugggcgcuccaaaguuaucaagggaagccugccccuuauuggcgaagcugacugucugcaugagaaauauggcgggcucaauaaguccaagccuuacuacacaggagagcacgccaaagcgaucggcaacugcccgaucugggugaagacaccccugaaacuggccaaugggaccaaguauagaccucccgcuaaacuccugaaggaacggggauuuuucggcgccauugcuggguuucuugagggcggaugggaaggcaugaucgccggguggcauggauacacgucucacggcgcccacggggucgcuguggcggccgaucucaagagcacccaggaggcuauuaacaaaaucacaaagaaucugaacucccugagcgaacuugagguuaaaaaucugcagcgccucucuggagccauggacgagcugcauaacgaaauucuggagcucgaugaaaagguggacgaccugagagccgauaccaucuccagccaaaucgagcuugcuguccugcucucuaaugaaggcauuaucaacagcgaggacgagcaucugcuugcccuggaacggaaacucaagaagaugcuggggccuuccgcgguggagauuggcaauggauguuucgaaacaaaacacaagugcaaccagaccugccuggaucgcaucgcugccggcacguuugacgccggggaguucucucuccccaccuuugauagccugaauauuacagcugccucccuuaacgacgauggacuggacaaucacaccauccuccuguauuacagcacagcugccucuucccuggcggucacccuuaugauugccaucuucgugguuuauauggugagcagagauaacgucucuuguuccaucugccucuga

SEQ ID NO: 210456 - RNA, 1758 nt, Artificial Sequence; identical to SEQ ID NO: 210013
  derived and/or modified sequence opt5 from hemagglutinin__InfluenzaB__AGX20756

SEQ ID NO: 210457 - RNA, 1758 nt, Artificial Sequence; identical to SEQ ID NO: 209632
  derived and/or modified sequence opt5 from hemagglutinin__InfluenzaB__AGX20767

SEQ ID NO: 210458 - RNA, 1758 nt, Artificial Sequence; identical to SEQ ID NO: 209669
  derived and/or modified sequence opt5 from hemagglutinin__InfluenzaB__AGX20778

SEQ ID NO: 210459 - RNA, 1758 nt, Artificial Sequence
  derived and/or modified sequence opt5 from hemagglutinin__InfluenzaB__AGX20789
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauggcgaaauccuggagcucgaugaaaaggucgacgaccugagagccgauaccauuuccagccaaaucgagcuugcugugcugcucucuaacgaagggaucauuaauagcgaggacgagcaucugcuugcccuggaacggaaacucaagaagaugcugggcccuuccgcggucgagaucggaaacggcuguuucgaaacaaaacacaagugcaaucagaccugccuggaucgcauugcugccgggacguuugacgccggagaguucucucuccccaccuuugauagccugaacaucacagcugccucccuuaaugacgauggccuggacaaccacaccauucuccuguauuacagcacagcugccucuucccuggcggugacccuuaugaucgccauuuucguuguguauauggucagcagagauaaugugucuuguuccaucugccucuga

SEQ ID NO: 210460 - RNA, 1758 nt, Artificial Sequence
  derived and/or modified sequence opt5 from hemagglutinin__InfluenzaB__AGX20800
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccuggaucgcauugcugccggcacguuugacgccggggaguucucucuccccaccuuugauagccugaauaucacagcugccucccuuaacgacgaugaacuggacaaucacaccauucuccuguauuacagcacagcugccucuucccuggcggugacccuuaugaucgccauuuucguuguguauauggucagcagagauaacgugucuuguuccaucugccucuga

SEQ ID NO: 210461 - RNA, 1758 nt, Artificial Sequence; identical to SEQ ID NO: 209707
  derived and/or modified sequence opt5 from hemagglutinin__InfluenzaB__AGX20811

SEQ ID NO: 210462 - RNA, 1758 nt, Artificial Sequence; identical to SEQ ID NO: 209707
  derived and/or modified sequence opt5 from hemagglutinin__InfluenzaB__AGX20822

SEQ ID NO: 210463 - RNA, 1758 nt, Artificial Sequence; identical to SEQ ID NO: 209707
  derived and/or modified sequence opt5 from hemagglutinin__InfluenzaB__AGX20833

SEQ ID NO: 210464 - RNA, 1758 nt, Artificial Sequence
  derived and/or modified sequence opt5 from hemagglutinin__InfluenzaB__AGX20844
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaugggcaagauccccucugccagagugagcauccugcacgagguccggccugugaccuccggguguuuucccauuaugcaugaucgcacaaaaaucagacaacucccuaaucugcugcggggauacgaacacauucgccucucuacccauaacguuaucaaugccgagaacgcuccgggcggccccuauaagauugggacgagcggauccugcccuaauaucacaaacggcaauggguucuuugccaccauggcuugggccgugcccaaaaacgacaagaauaaaacagcgaccaacccucugaccauugaaguccccuacaucuguacagagggagaggaucagaucacgguguggggcuuccacagcgacaaugaaacccagauggccaaacuuuauggggauucuaagccgcagaaguuuacauccagcgcuaacggagugaccacacacuacgucucucaaauuggcggcuucccuaaccagaccgaggacgggggacugccccaguccggcagaaucguuguggauuauauggugcaaaagagcgggaaaacgggaacaauuaccuaccagcggggcauccuccugccucagaaggucuggugcgccucugggcgcuccaaagugauuaagggaagccuuccccugaucggcgaagcugacugucuccaugagaaauauggcgggcugaauaaguccaagcccuacuacaccggagagcacgccaaagcgaucggcaacugcccuauuuggguuaagacaccgcugaaacucgccaaugggaccaaguauagacccccugcuaaacugcuuaaggaacggggauuuuucggcgccaucgcuggguuucuggagggcggaugggaaggcaugauugccggguggcauggauacacaucucacggcgcccacgggguggcugucgcggccgaucucaagagcacgcaggaggcuaucaacaaaauuaccaagaaucugaacucccuuagcgaacuggaggugaaaaaucuccagcgccugucuggagccauggacgagcugcauaacgaaauccucgagcuggaugaaaagguugacgaccuuagagccgauacaaucuccagccaaauugagcuggcugugcuccugucuaaugaaggcaucauuaacagcgaggacgagcaccuucuggcccucgaacggaaacugaagaagaugcuggggcccuccgcggucgagaucggcaauggauguuucgaaaccaaacauaagugcaaccagacaugccucgaucgcauugcugccggcaccuuugacgccggggaguucucucugccuacguuugauagccuuaauaucaccgcugccucccugaacgacgauggacucgacaaucacacaauucugcuguauuacagcaccgcugccucuucccuugcggugacacucaugaucgccaucuucgucguguauaugguuagcagagauaacgugucuuguuccauuugccuguga

SEQ ID NO: 210465 - RNA, 1758 nt, Artificial Sequence; identical to SEQ ID NO: 209632
  derived and/or modified sequence opt5 from hemagglutinin__InfluenzaB__AGX20855

SEQ ID NO: 210466 - RNA, 1758 nt, Artificial Sequence; identical to SEQ ID NO: 209707
  derived and/or modified sequence opt5 from hemagglutinin__InfluenzaB__AGX20866

SEQ ID NO: 210467 - RNA, 1758 nt, Artificial Sequence; identical to SEQ ID NO: 209707
  derived and/or modified sequence opt5 from hemagglutinin__InfluenzaB__AGX20877

SEQ ID NO: 210468 - RNA, 1758 nt, Artificial Sequence
  derived and/or modified sequence opt5 from hemagglutinin__InfluenzaB__AGX20888
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacucugaaacacagauggccaagcuguauggggauuccaagccucagaaauuuaccagcucugcuaauggaguuacaacccacuacgugucccaaaucggcggcuuccccaaccagacggaggacgggggacuuccucagagcggcagaaucguggucgauuauauggugcagaagucugggaaaacaggaaccauuaccuaccaacggggcauccugcucccccagaagguuuggugcgccuccgggcgcagcaaagugauuaagggaucccugccccuuaucggcgaagcugacugucugcaugagaaauauggcgggcucaacaagucuaagccuuacuacacaggagagcacgccaaagcgauuggcaauugcccgaucugggucaagacaccccugaaacuggccaacgggaccaaguauagaccucccgcuaaacuccugaaggaacggggauuuuucggcgccaucgcuggguuucuugagggcggaugggaaggcaugauugccggguggcauggauacacgagccacggcgcccacgggguggcuguugcggccgaucugaaguccacccaggaggcuaucaauaaaauuacaaagaaccucaauagccugucugaacuugaggugaaaaaccugcagcgccucuccggagccauggacgagcugcauaaugaaauccuggagcucgaugaaaaggucgacgaccugagagccgauaccauuagcucucaaaucgagcuugcugugcugcucagcaacgaaggcaucauuaauuccgaggacgagcaucugcuugcccuggaacggaaacucaagaagaugcuggggccuucugcggucgagaucggcaacggauguuucgaaacaaaacacaagugcaaucagaccugccuggaucgcauugcugccggcacguuugacgccggggaguucagccuccccaccuuugauucccugaacaucacagcugccagccuuaaugacgauggacuggacaaccacaccauucuccuguauuacucuacagcugccuccagccuggcggugacccuuaugaucgccauuuucguuguguauauggucucuagagauaauguguccuguagcaucugccucuga

SEQ ID NO: 210469 - RNA, 1758 nt, Artificial Sequence; identical to SEQ ID NO: 209707
  derived and/or modified sequence opt5 from hemagglutinin__InfluenzaB__AGX20899

SEQ ID NO: 210470 - RNA, 1758 nt, Artificial Sequence; identical to SEQ ID NO: 209707
  derived and/or modified sequence opt5 from hemagglutinin__InfluenzaB__AGX20910

SEQ ID NO: 210471 - RNA, 1758 nt, Artificial Sequence; identical to SEQ ID NO: 209632
  derived and/or modified sequence opt5 from hemagglutinin__InfluenzaB__AGX20921

SEQ ID NO: 210472 - RNA, 1758 nt, Artificial Sequence
  derived and/or modified sequence opt5 from hemagglutinin__InfluenzaB__AGX20932
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauccuaagccccagaaauuuaccucuuccgcuaacggaguuacaacccacuacgugagccaaaucggcggcuucccuaaccagacggaggacgggggacuuccccagucuggcagaaucguggucgauuauauggugcagaaguccgggaaaacaggaaccauuaccuaccaacggggcauccugcucccccagaagguuuggugcgccagcgggcgcucuaaagugauuaagggaucccugccucuuaucggcgaagcugacugucugcaugagaaauauggcgggcucaauaagagcaagccguacuacacaggagagcacgccaaagcgauuggcaacugccccaucugggucaagaccccucugaaacuggccaaugggacaaaguauagacccccugcuaaacuccugaaggaacggggauuuuucggcgccaucgcuggguuucuugagggcggaugggaaggcaugauugccggguggcauggauacacgucccacggcgcccacgggguggcuguugcggccgaucugaagucuacccaggaggcuaucaacaaaauuacaaagaaucucaacagccuguccgaacuugaggugaaaaaucugcagcgccucagcggagccauggacgagcugcauaacgaaauccuggagcucgaugaaaaggucgacgaccugagagccgauaccauuucuucccaaaucgagcuugcugugcugcucagcaaugaaggcaucauuaacucugaggacgagcaucugcuugcccuggaacggaaacucaagaagaugcuggggcccagcgcggucgagaucggcaauggauguuucgaaacaaaacacaagugcaaccagaccugccuggaucgcauugcugccggcacguuugacgccggggaguucucccucccgaccuuugauucucugaauaucacagcugccagccuuaacgacgauggacuggacaaucacaccauucuccuguauuacuccacagcugccagcucucuggcggugacccuuaugaucgccauuuucguuguguauauggucuccagagauaacgugagcuguucuaucugccucuga

SEQ ID NO: 210473 - RNA, 1758 nt, Artificial Sequence; identical to SEQ ID NO: 209632
  derived and/or modified sequence opt5 from hemagglutinin__InfluenzaB__AGX20943

SEQ ID NO: 210474 - RNA, 1758 nt, Artificial Sequence; identical to SEQ ID NO: 209632
  derived and/or modified sequence opt5 from hemagglutinin__InfluenzaB__AGX20954

SEQ ID NO: 210475 - RNA, 1758 nt, Artificial Sequence; identical to SEQ ID NO: 209632
  derived and/or modified sequence opt5 from hemagglutinin__InfluenzaB__AGX20965

SEQ ID NO: 210476 - RNA, 1758 nt, Artificial Sequence
  derived and/or modified sequence opt5 from hemagglutinin__InfluenzaB__AGX20976
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauggcgaaauccucgagcuggaugaaaaggucgacgaccuuagagccgauaccauuuccagccaaaucgagcuggcugugcuccugucuaacgaagggaucauuaauagcgaggacgagcaccuucuggcccucgaacggaaacugaagaagaugcugggccccuccgcggucgagaucggaaacggcuguuucgaaacaaaacauaagugcaaucagaccugccucgaucgcauugcugccgggacguuugacgccggagaguucucucugccuaccuuugauagccuuaacaucacagcugccucccugaaugacgauggccucgacaaccacaccauucugcuguauuacagcacagcugccucuucccuugcggugacccucaugaucgccauuuucguuguguauauggucagcagagauaaugugucuuguuccaucugccuguga

SEQ ID NO: 210477 - RNA, 1758 nt, Artificial Sequence; identical to SEQ ID NO: 209632
  derived and/or modified sequence opt5 from hemagglutinin__InfluenzaB__AGX20987

SEQ ID NO: 210478 - RNA, 1758 nt, Artificial Sequence; identical to SEQ ID NO: 209707
  derived and/or modified sequence opt5 from hemagglutinin__InfluenzaB__AGX20998

SEQ ID NO: 210479 - RNA, 1758 nt, Artificial Sequence
  derived and/or modified sequence opt5 from hemagglutinin__InfluenzaB__AGX21009
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccuggaucgcauugcugccggcacguuugacgccggggaguucucucuccccaccuuugauagccugaauaucacagcugccucccuuaacgacgauggacuggacaaucacaccauucuccuguauuacagcacagcugccucuucccuggcggugacccuuaugaucgccauuuucguuguguauaugaucagcagagauaacgucucuuguuccaucugccucuga

SEQ ID NO: 210480 - RNA, 1758 nt, Artificial Sequence
  derived and/or modified sequence opt5 from hemagglutinin__InfluenzaB__AGX21020
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucugagccgcagaaguuuaccuccagcgcuaacggaguuacaacccacuacgugucucaaaucggcggcuucccuaaccagacggaagacgggggacugccccaguccggcagaaucguggucgauuauauggugcagaaaagcgggaagacaggaaccauuaccuaccaacggggcauccuccugccucagaaaguuuggugcgccucugggcgcuccaaggugauuaaaggaagccuuccccugaucggcgaggcugacugucuccaugagaaguauggcgggcugaauaaauccaagcccuacuacacaggagaacacgccaaggcgauuggcaacugcccuaucugggucaaaaccccgcugaagcucgccaaugggacaaaauauagacccccugcuaagcugcuuaaagagcggggauuuuucggcgccaucgcuggguuucuggaaggcggaugggagggcaugauugccggguggcauggauacacgucucacggcgcccacgggguggcuguugcggccgaucucaagagcacccaggaagcuaucaacaagauuacaaagaaucugaacucccuuagcgagcuggaggugaagaaucuccagcgccugucuggagccauggacgaacugcauaacgagauccucgaacuggaugagaaagucgacgaccuuagagccgauaccauuuccagccaaaucgaacuggcugugcuccugucuaaugagggcaucauuaacagcgaggacgaacaccuucuggcccucgagcggaagcugaaaaagaugcuggggcccuccgcggucgaaaucggcaauggauguuucgagacaaagcauaaaugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagcagagauaacgugucuuguuccaucugccuguga

SEQ ID NO: 210481 - RNA, 1758 nt, Artificial Sequence; identical to SEQ ID NO: 209707
  derived and/or modified sequence opt5 from hemagglutinin__InfluenzaB__AGX21031

SEQ ID NO: 210482 - RNA, 1758 nt, Artificial Sequence
  derived and/or modified sequence opt5 from hemagglutinin__InfluenzaB__AGX21042
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaauacagagaacgccccgggcggccccuauaagaucgggaccagcggauccugcccuaaugucacaaacggcaauggguucuuugcuaccauggccugggcugugcccaaaaacgacaagaauaaaaccgccacaaacccucugacgauugaagugcccuacaucuguaccgagggagaggaucagauuacagucuggggcuuccacagcgacaaugaaacccagauggcgaaacuuuauggggauucuaagccgcagaaguuuacauccagcgccaacggaguuaccacgcacuacgugucucaaaucggcggcuucccuaaccagacagaggacgggggacugccccaguccggcagaaucguggucgauuauauggugcaaaagagcgggaaaaccggaaccauuacauaccagcggggcauccuccugccucagaagguuuggugcgcuucugggcgcuccaaagugauuaagggaagccuuccccugaucggcgaagccgacugucuccaugagaaauauggcgggcugaauaaguccaagcccuacuacaccggagagcacgcuaaagccauuggcaacugcccuaucugggucaagacaccgcugaaacucgcgaaugggacgaaguauagacccccugccaaacugcuuaaggaacggggauuuuucggcgcuaucgccggguuucuggagggcggaugggaaggcaugauugcuggguggcauggauacaccucucacggcgcccacgggguggccguugcugcggaucucaagagcacacaggaggccaucaacaaaauuaccaagaaucugaacucccuuagcgaacuggaggugaaaaaucuccagcgccugucuggagcuauggacgagcugcauaacgaaauccucgagcuggaugaaaaggucgacgaccuuagagccgauacaauuuccagccaaaucgagcuggccgugcuccugucuaaugaaggcaucauuaacagcgaggacgagcaccuucuggcucucgaacggaaacugaagaagaugcuggggcccuccgccgucgagaucggcaauggauguuucgaaaccaaacauaagugcaaccagacgugccucgaucgcauugcggcuggcaccuuugacgccggggaguucucucugccuacauuugauagccuuaauaucaccgccgcuucccugaacgacgauggacucgacaaucacacaauucugcuguauuacagcaccgccgcuucuucccuugccgugacgcucaugaucgcgauuuucguuguguauauggucagcagagauaacgugucuuguuccaucugccuguga

SEQ ID NO: 210483 - RNA, 1758 nt, Artificial Sequence; identical to SEQ ID NO: 209669
  derived and/or modified sequence opt5 from hemagglutinin__InfluenzaB__AGX21053

SEQ ID NO: 210484 - RNA, 1758 nt, Artificial Sequence; identical to SEQ ID NO: 209632
  derived and/or modified sequence opt5 from hemagglutinin__InfluenzaB__AGX21064

SEQ ID NO: 210485 - RNA, 1758 nt, Artificial Sequence; identical to SEQ ID NO: 209669
  derived and/or modified sequence opt5 from hemagglutinin__InfluenzaB__AGX21075

SEQ ID NO: 210486 - RNA, 1758 nt, Artificial Sequence; identical to SEQ ID NO: 209669
  derived and/or modified sequence opt5 from hemagglutinin__InfluenzaB__AGX21084

SEQ ID NO: 210487 - RNA, 1758 nt, Artificial Sequence; identical to SEQ ID NO: 209669
  derived and/or modified sequence opt5 from hemagglutinin__InfluenzaB__AGX21095

SEQ ID NO: 210488 - RNA, 1758 nt, Artificial Sequence
  derived and/or modified sequence opt5 from hemagglutinin__InfluenzaB__AGX21106
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaagcccagauggcuaagcuguauggggauucuaagccucagaaauuuacauccagcgccaacggaguuaccacacacuacgugucucaaaucggcggcuuccccaaccagaccgaggacgggggacuuccucaguccggcagaaucguggucgauuauauggugcaaaagagcgggaaaacgggaacaauuaccuaccagcggggcauccugcucccccagaagguuuggugcgcuucugggcgcuccaaagugauuaagggaagccugccccuuaucggcgaagccgacugucugcaugagaaauauggcgggcucaauaaguccaagccuuacuacaccggagagcacgcgaaagccauuggcaacugcccgaucugggucaagacaccccugaaacuggcuaaugggaccaaguauagaccucccgccaaacuccugaaggaacggggauuuuucggcgcuaucgccggguuucuugagggcggaugggaaggcaugauugccggguggcauggauacacaucucacggcgcucacgggguggcgguugccgcugaucucaagagcacgcaggaggccaucaacaaaauuaccaagaaucugaacucccugagcgaacuugaggugaaaaaucugcagcgccucucuggagccauggacgagcugcauaacgaaauccuggagcucgaugaaaaggucgacgaccugagagcugauacaauuuccagccaaaucgagcuugccgugcugcucucuaaugaaggcaucauuaacagcgaggacgagcaucugcuugcgcuggaacggaaacucaagaagaugcuggggccuuccgcugucgagaucggcaauggauguuucgaaaccaaacacaagugcaaccagacaugccuggaucgcauugccgccggcaccuuugacgcuggggaguucucucuccccacguuugauagccugaauaucaccgccgcuucccuuaacgacgauggacuggacaaucacacaauucuccuguauuacagcaccgccgcgucuucccuggccgugacacuuaugaucgcuauuuucguuguguauauggucagcagagauaacgugucuuguuccaucugccucuga

SEQ ID NO: 210489 - RNA, 1758 nt, Artificial Sequence; identical to SEQ ID NO: 209632
  derived and/or modified sequence opt5 from hemagglutinin__InfluenzaB__AGX21117

SEQ ID NO: 210490 - RNA, 1758 nt, Artificial Sequence; identical to SEQ ID NO: 210482
  derived and/or modified sequence opt5 from hemagglutinin__InfluenzaB__AGX21128

SEQ ID NO: 210491 - RNA, 1758 nt, Artificial Sequence
  derived and/or modified sequence opt5 from hemagglutinin__InfluenzaB__AGX21139
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcgacuuccccaaccagacggaggauggcgggcuuccucaguccggaagaaucguggucgacuauauggugcaaaagagcggcaaaacagggaccauuaccuaccagcggggaauccugcucccccagaagguuuggugcgccucuggccgcuccaaagugauuaaggggagccugccccuuaucggagaagcugauugucugcaugagaaauauggcggccucaauaaguccaagccuuacuacacaggggagcacgccaaagcgauuggaaacugcccgaucugggucaagacaccccugaaacuggccaauggcaccaaguauagaccucccgcuaaacuccugaaggaacggggguuuuucggagccaucgcuggcuuucuugaagggggcugggagggaaugauugccggcuggcauggguacacgucucacggagcccacggcguggcuguugcggccgaccucaagagcacccaggaggcuaucaacaaaauuacaaagaaucugaacucccugagcgaacuugaggugaaaaaucugcagcgccucucuggggccauggaugagcugcauaacgaaauccuggagcucgacgaaaaggucgacgaucugagagccgacaccauuuccagccaaaucgagcuugcugugcugcucucuaaugaaggaaucauuaacagcgaggaugagcaucugcuugcccuggaacggaaacucaagaagaugcugggcccuuccgcggucgagaucgggaauggcuguuucgaaacaaaacacaagugcaaccagaccugccuggaccgcauugcugccggaacguuugaugccggcgaguucucucuccccaccuuugacagccugaauaucacagcugccucccuuaacgaugacgggcuggauaaucacaccauucuccuguauuacagcacagcugccucuucccuggcggugacccuuaugaucgccauuuucguuguguauauggucagcagagacaacgugucuuguuccaucugccucuga

SEQ ID NO: 210492 - RNA, 1758 nt, Artificial Sequence; identical to SEQ ID NO: 209707
  derived and/or modified sequence opt5 from hemagglutinin__InfluenzaB__AGX21150

SEQ ID NO: 210493 - RNA, 1758 nt, Artificial Sequence; identical to SEQ ID NO: 209632
  derived and/or modified sequence opt5 from hemagglutinin__InfluenzaB__AGX21161

SEQ ID NO: 210494 - RNA, 1758 nt, Artificial Sequence; identical to SEQ ID NO: 209707
  derived and/or modified sequence opt5 from hemagglutinin__InfluenzaB__AGX21172

SEQ ID NO: 210495 - RNA, 1758 nt, Artificial Sequence; identical to SEQ ID NO: 209669
  derived and/or modified sequence opt5 from hemagglutinin__InfluenzaB__AGX21183

SEQ ID NO: 210496 - RNA, 1758 nt, Artificial Sequence; identical to SEQ ID NO: 209707
  derived and/or modified sequence opt5 from hemagglutinin__InfluenzaB__AGX21194

SEQ ID NO: 210497 - RNA, 1758 nt, Artificial Sequence
  derived and/or modified sequence opt5 from hemagglutinin__InfluenzaB__AGX21205
augaaggccaucauugugcugcucauggucguuaccagcaacgcugacagaaucugcacaggcauuacguccucuaauagcccccacaucgugaaaaccgccacacagggggaagugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccaagaacgcuccgggcggccccuauaaaauugggacaagcggauccugcccuaauaucaccaacggcaauggguucuuugccacaauggcuugggccgugcccaagaacgacaaaaauaagaccgcgaccaacccucugacaauugagguccccuacaucuguacggaaggagaggaucagaucaccguguggggcuuccacagcgacaaugagacacagauggccaaacuuuauggggauucuaaaccgcagaaguuuaccuccagcgcuaacggagugacaacccacuacgucucucaaauuggcggcuucccuaaccagacggaagacgggggacugccccaguccggcagaaucguuguggauuauauggugcagaaaagcgggaagacaggaaccauuaccuaccaacggggcauccuccugccucagaaagucuggugcgccucugggcgcuccaaggugauuaaaggaagccuuccccugaucggcgaggcugacugucuccaugaaaaguauggcgggcugaauaaguccaaacccuacuacacaggagagcacgccaaggcgaucggcaacugcccuauuuggguuaaaaccccgcugaagcucgccaaugggacaaaauauagacccccugcuaagcugcuuaaggagcggggauuuuucggcgccaucgcuggguuucuggaaggcggaugggagggcaugauugccggguggcauggauacacgucucacggcgcccacgggguggcugucgcggccgaucucaaaagcacccaggaagcuaucaacaagauuacaaagaaucugaacucccuuagcgagcuggaagugaagaaucuccagcgccugucuggagccauggacgagcugcauaacgagauccucgaacuggaugagaaaguugacgaccuuagagccgauaccaucuccagccaaauugaacuggcugugcuccugucuaaugagggcaucauuaacagcgaagacgagcaccuucuggcccucgagcggaagcugaagaaaaugcuggggcccuccgcggucgaaaucggcaauggauguuucgagacaaagcauaaaugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccaucuucgucguguauaugguuagcagagauaacgugucuuguuccauuugccuguga

SEQ ID NO: 210498 - RNA, 1758 nt, Artificial Sequence; identical to SEQ ID NO: 209669
  derived and/or modified sequence opt5 from hemagglutinin__InfluenzaB__AGX21216

SEQ ID NO: 210499 - RNA, 1758 nt, Artificial Sequence; identical to SEQ ID NO: 209632
  derived and/or modified sequence opt5 from hemagglutinin__InfluenzaB__AGX21227

SEQ ID NO: 210500 - RNA, 1758 nt, Artificial Sequence
  derived and/or modified sequence opt5 from hemagglutinin__InfluenzaB__AGX21238
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccaaugggcgcucuaaagugauuaagggaucccuuccccugaucggcgaagcugacugucuccaugagaaauauggcgggcugaacaagagcaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucccacggcgcccacgggguggcuguugcggccgaucucaagucuacccaggaggcuaucaauaaaauuacaaagaaccugaauagccuuuccgaacuggaggugaaaaaccuccagcgccugagcggagccauggacgagcugcauaaugaaauccucgagcuggaugaaaaggucgacgaccuuagagccgauaccauuucuucccaaaucgagcuggcugugcuccugagcaacgaaggcaucauuaauucugaggacgagcaccuucuggcccucgaacggaaacugaagaagaugcuggggcccagcgcggucgagaucggcaacggauguuucgaaacaaaacauaagugcaaucagaccugccucgaucgcauugcugccggcacguuugacgccggggaguucucccugccuaccuuugauucucuuaacaucacagcugccagccugaaugacgauggacucgacaaccacaccauucugcuguauuacuccacagcugccagcucucuugcggugacccucaugaucgccauuuucguuguguauaugaucuccagagauaacgucagcuguucuaucugccuguga

SEQ ID NO: 210501 - RNA, 1758 nt, Artificial Sequence; identical to SEQ ID NO: 209707
  derived and/or modified sequence opt5 from hemagglutinin__InfluenzaB__AGX21249

SEQ ID NO: 210502 - RNA, 1758 nt, Artificial Sequence
  derived and/or modified sequence opt5 from hemagglutinin__InfluenzaB__AGX21260
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaauuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagcgcguuuggugcgccucugggagauccaaggugauuaaaggaagccuuccccugaucggcgaagcugacugucuccaugagaaguauggcgggcugaauaaauccaagcccuacuacacaggagagcacgccaaggcgauuggcaacugcccuaucugggucaaaaccccgcugaagcucgccaaugggacaaaauaucggcccccugcuaagcugcuuaaagaacgcggauuuuucggcgccaucgcuggguuucuggagggcggaugggaaggcaugauugccggguggcauggauacacgucucacggcgcccacgggguggcuguugcggccgaucucaagagcacccaggaggcuaucaacaagauuacaaagaaucugaacucccuuagcgaacuggaggugaagaaucuccagagacugucuggagccauggacgagcugcauaacgaaauccucgagcuggaugaaaaagucgacgaccuucgggccgauaccauuuccagccaaaucgagcuggcugugcuccugucuaaugaaggcaucauuaacagcgaggacgagcaccuucuggcccucgaacgcaagcugaaaaagaugcuggggcccuccgcggucgagaucggcaauggauguuucgaaacaaagcauaaaugcaaccagaccugccucgauagaauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagccgggauaacgugucuuguuccaucugccuguga

SEQ ID NO: 210503 - RNA, 1758 nt, Artificial Sequence; identical to SEQ ID NO: 209632
  derived and/or modified sequence opt5 from hemagglutinin__InfluenzaB__AGX21271

SEQ ID NO: 210504 - RNA, 1758 nt, Artificial Sequence
  derived and/or modified sequence opt5 from hemagglutinin__InfluenzaB__AGX21282
augaaggccaucauugugcugcucauggucguuaccagcaacgcugacagaaucugcacaggcauuacguccucuaauagcccccacaucgugaaaaccgccacacagggggaagugaacgucaccggagugauuccucugacaaccuccccgacaaagucucauuucgcgaaucuuaaaggcaccgaaacgcgggggaagcugugucccaaaugccucaacuguaccgaucuggacguugcucuuggacgcccuaagugcacaggcaagauccccagcgccagaguguccauccugcacgagguccggccugugaccucuggguguuuucccauuaugcaugaucgcacaaaaaucagacaacucccuaaucugcugcggggauacgaacacauucgccucagcacccauaacguuaucaaugccaagaacgcuccgggcggccccuauaaaauugggacguccggaagcugcccuaauaucacaaacggcaauggguucuuugccaccauggcuugggccgugcccaagaacgacaaaaauaagacagcgaccaacccucugaccauugagguccccuacaucuguacagaaggagaggaucagaucacgguguggggcuuccacucugacaaugagacccagauggccaaacuuuauggggauuccaagccgcagaaguuuacaagcucugcuaacggagugaccacacacuacgucucccaaauuggcggcuucccuaaccagaccgaagacgggggacugccccagagcggcagaaucguuguggauuauauggugcagaaaucugggaagacgggaacaauuaccuaccaacggggcauccuccugccucagaaagucuggugcgccuccgggcgcagcaaggugauuaaaggaucccuuccccugaucggcgaggcugacugucuccaugaaaaguauggcgggcugaauaagucuaaacccuacuacaccggagagcacgccaaggcgaucggcaacugcccuauuuggguuaaaacaccgcugaagcucgccaaugggaccaaauauagacccccugcuaagcugcuuaaggagcggggauuuuucggcgccaucgcuggguuucuggaaggcggaugggagggcaugauugccggguggcauggauacacaagccacggcgcccacgggguggcugucgcggccgaucucaaauccacgcaggaagcuaucaacaagauuaccaaaaaucugaacagccuuucugagcuggaagugaagaaucuccagcgccuguccggagccauggacgagcugcauaacgagauccucgaacuggaugagaaaguugacgaccuuagagccgauacaaucagcucucaaauugaacuggcugugcuccugagcaaugagggcaucauuaacuccgaagacgagcaccuucuggcccucgagcggaagcugaagaaaaugcuggggcccucugcggucgaaaucggcaauggauguuucgagaccaagcauaaaugcaaccagacaugccucgaucgcauugcugccggcaccuuugacgccggggaguucagccugccuacguuugauucccuuaauaucaccgcugccagccugaacgacgauggacucgacaaucacacaauucugcuguauuacucuaccgcugccuccagccuugcggugacacucaugaucgccaucuucgucguguauaugguuucuagagauaacguguccuguagcauuugccuguga

SEQ ID NO: 210505 - RNA, 1758 nt, Artificial Sequence; identical to SEQ ID NO: 209669
  derived and/or modified sequence opt5 from hemagglutinin__InfluenzaB__AGX21293

SEQ ID NO: 210506 - RNA, 1758 nt, Artificial Sequence; identical to SEQ ID NO: 209707
  derived and/or modified sequence opt5 from hemagglutinin__InfluenzaB__AGX21304

SEQ ID NO: 210507 - RNA, 1758 nt, Artificial Sequence; identical to SEQ ID NO: 209669
  derived and/or modified sequence opt5 from hemagglutinin__InfluenzaB__AGX21315

SEQ ID NO: 210508 - RNA, 1758 nt, Artificial Sequence; identical to SEQ ID NO: 209632
  derived and/or modified sequence opt5 from hemagglutinin__InfluenzaB__AGX21326

SEQ ID NO: 210509 - RNA, 1758 nt, Artificial Sequence
  derived and/or modified sequence opt5 from hemagglutinin__InfluenzaB__AGX21337
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaggaaacacagauggccaagcuguauggggauucuaaaccucagaaguuuaccuccagcgcuaauggaguuacaacccacuacgugucucaaaucggcggcuuccccaaccagacggaggacgggggacuuccucaguccggcagaaucguggucgauuauauggugcagaaaagcgggaagacaggaaccauuaccuaccaacggggcauccugcucccccagaaaguuuggugcgccucugggcgcuccaaggugauuaaaggaagccugccccuuaucggcgaagcugacugucugcaugagaaguauggcgggcucaacaaguccaaaccuuacuacacaggagagcacgccaaggcgauuggcaauugcccgaucugggucaaaacaccccugaagcuggccaacgggacaaaauauagaccucccgcuaagcuccugaaggaacggggauuuuucggcgccaucgcuggguuucuugagggcggaugggaaggcaugauugccggguggcauggauacacgucucacggcgcccacgggguggcuguugcggccgaucugaaaagcacccaggaggcuaucaauaagauuaccaaaaaccucaauucccugagcgaacuugaggugaagaaccugcagcgccucucuggagccauggacgagcugcauaaugaaauccuggagcucgaugaaaaagucgacgaccugagagccgauaccauuuccagccaaaucgagcuugcugugcugcucucuaacgaaggcaucauuaauagcgaggacgagcaucugcuugcccuggaacggaagcucaagaaaaugcuggggccuuccgcggucgagaucggcaacggauguuucgaaacaaagcacaaaugcaaucagaccugccuggaucgcauugcugccggcacguuugacgccggggaguucucucuccccaccuuugauagccugaacaucacagcugccucccuuaaugacgauggacuggacaaccacaccauucuccuguauuacagcacagcugccucuucccuggcggugacccuuaugaucgccauuuucguuguguauauggucagcagagauaaugugucuuguuccaucugccucuga

SEQ ID NO: 210510 - RNA, 1758 nt, Artificial Sequence; identical to SEQ ID NO: 209669
  derived and/or modified sequence opt5 from hemagglutinin__InfluenzaB__AGX21348

SEQ ID NO: 210511 - RNA, 1758 nt, Artificial Sequence; identical to SEQ ID NO: 209669
  derived and/or modified sequence opt5 from hemagglutinin__InfluenzaB__AGX21359

SEQ ID NO: 210512 - RNA, 1758 nt, Artificial Sequence
  derived and/or modified sequence opt5 from hemagglutinin__InfluenzaB__AGX21370
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaugggcaagauuccuucugccagagucagcauccuucacgaggugcggcccguuaccuccggguguuuuccuaucaugcaugaucgcacaaaaauuagacaacugccgaaucuccugcggggauacgaacacauccgccugucuacccauaacgugauuaaugccgagaacgcucccggcggcccuuauaagaucgggacgagcggauccugccccaaugucacaaacggcaauggguucuuugccaccauggcuugggccgugccuaaaaacgacaagaauaaaacagcgaccaacccccucaccauugaagugccguacaucuguacagagggagaggaucagauuacggucuggggcuuccacagcgacaaugaaacccagauggccaagcuguauggggauucuaagccucagaaauuuacauccagcgcuaacggaguuaccacacacuacgugucucaaaucggcggcuuccccaaccagaccgaggacgggggacuuccucaguccggcagaaucguggucgauuauauggugcaaaagagcgggaaaacgggaacaauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacaccggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacaucucacggcgcccacgggguggcuguugcggccgaucucaagagcacgcaggaggcuaucaacaaaauuaccaagaaucugaacucccugagcgaacuugaggugaaaaaucugcagcgccucucuggagccauggacgagcugcauaacgaaauccuggagcucgaugaaaaggucgacgaccugagagccgauacaauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaaccaaacacaagugcaaccagacaugccuggaucgcauugcugccggcaccuuugacgccggggaguucucucuccccacguuugauagccugaauaucaccgcugccucccuuaacgacgauggacuggacaaucacacaauucuccuguauuacagcaccgcugccucuucccuggcggugacacuuaugaucgccauuuucguuguguauauggucagcagagauaacgugucuuguuccaucugccucuga

SEQ ID NO: 210513 - RNA, 1758 nt, Artificial Sequence
  derived and/or modified sequence opt5 from hemagglutinin__InfluenzaB__AGX21381
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacaacccacuacauuucucaaaucggcggcuucccuaaccagacggaggacgggggacugccccaguccggcagaauugucguugauuauauggugcaaaagagcgggaaaacaggaaccaucaccuaccagcggggcauucuccugccucagaagguguggugcgccucugggcgcuccaaagucaucaagggaagccuuccccugaucggcgaagcugacugucuccaugagaaauauggcgggcugaauaaguccaagcccuacuacacaggagagcacgccaaagcgauuggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacgggguugcuguggcggccgaucucaagagcacccaggaggcuauuaacaaaaucacaaagaaucugaacucccuuagcgaacuggaggucaaaaaucuccagcgccugucuggagccauggacgagcugcauaacgaaauccucgagcuggaugaaaagguggacgaccuuagagccgauaccauuuccagccaaaucgagcuggcuguucuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugaucgccauuuucguggucuauauggugagcagagauaacguuucuuguuccaucugccuguga

SEQ ID NO: 210514 - RNA, 1758 nt, Artificial Sequence
  derived and/or modified sequence opt5 from hemagglutinin__InfluenzaB__AGX21392
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaagcccagauggcuaaacuuuauggggauucuaagccgcagaaguuuacauccagcgccaacggagugaccacacacuacgucucucaaauuggcggcuucccuaaccagaccgaggacgggggacugccccaguccggcagaaucguuguggauuauauggugcaaaagagcgggaaaacgggaacaauuaccuaccagcggggcauccuccugccucagaaggucuggugcgcuucugggcgcuccaaagugauuaagggaagccuuccccugaucggcgaagccgacugucuccaugagaaauauggcgggcugaauaaguccaagcccuacuacaccggagagcacgcgaaagccaucggcaacugcccuauuuggguuaagacaccgcugaaacucgcuaaugggaccaaguauagacccccugccaaacugcuuaaggaacggggauuuuucggcgcuaucgccggguuucuggagggcggaugggaaggcaugauugccggguggcauggauacacaucucacggcgcucacgggguggcggucgccgcugaucucaagagcacgcaggaggccaucaacaaaauuaccaagaaucugaacucccuuagcgaacuggaggugaaaaaucuccagcgccugucuggagccauggacgagcugcauaacgaaauccucgagcuggaugaaaagguugacgaccuuagagcugauacaaucuccagccaaauugagcuggccgugcuccugucuaaugaaggcaucauuaacagcgaggacgagcaccuucuggcgcucgaacggaaacugaagaagaugcuggggcccuccgcugucgagaucggcaauggauguuucgaaaccaaacauaagugcaaccagacaugccucgaucgcauugccgccggcaccuuugacgcuggggaguucucucugccuacguuugauagccuuaauaucaccgccgcuucccugaacgacgauggacucgacaaucacacaauucugcuguauuacagcaccgccgcgucuucccuugccgugacacucaugaucgcuaucuucgucguguauaugguuagcagagauaacgugucuuguuccauuugccuguga

SEQ ID NO: 210515 - RNA, 1758 nt, Artificial Sequence
  derived and/or modified sequence opt5 from hemagglutinin__InfluenzaB__AGX21403
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccugaaucgcauugcugccggcacguuugaugccggggaguucucucuccccaccuuugacagccugaacaucacagcugccucccuuaaugaugacggacuggauaaccacaccauucuccuguauuacagcacagcugccucuucccuggcggugacccuuaugaucgccauuuucguuguguauauggucagcagagacaacgugucuuguuccaucugccucuga

SEQ ID NO: 210516 - RNA, 1758 nt, Artificial Sequence
  derived and/or modified sequence opt5 from hemagglutinin__InfluenzaB__AGX21414
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccgauccccucacaauugaagugccguacaucuguacggagggagaggaccagauuaccgucuggggcuuccacagcgauaacgaaacacagauggccaagcuguauggggacucuaagccucagaaauuuaccuccagcucuaauggaguuacaacccacuacgugucccaaaucggcggcuuccccaaccagacggaggaugggggacuuccucagagcggcagaaucguggucgacuauauggugcagaagucugggaaaacaggaaccauuaccuaccaacggggcauccugcucccccagaagguuuggugcgcuuccgggcgcagcaaagugauuaagggaucccugccccuuaucggcgaagccgauugucugcaugagaaauauggcgggcucaacaagucuaagccuuacuacacaggagagcacgcuaaagccauuggcaauugcccgaucugggucaagacaccccugaaacuggcgaacgggaccaaguauagaccucccgccaaacuccugaaggaacggggauuuuucggcgcuaucgccggguuucuugagggcggaugggaaggcaugauugcuggguggcauggauacacgagccacggcgcccacgggguggccguugcugcggaccugaaguccacccaggaggccaucaauaaaauuacaaagaaccucaauagccugucugaacuugaggugaaaaaccugcagcgccucuccggagcuauggaugagcugcauaaugaaauccuggagcucgacgaaaaggucgacgaucugagagccgacaccauuagcucucaaaucgagcuugccgugcugcucagcaacgaaggcaucauuaauuccgaggaugagcaucugcuugcucuggaacggaaacucaagaagaugcuggggccuucugccgucgagaucggcaacggauguuucgaaacaaaacacaagugcaaucagaccugccuggaccgcauugcggcuggcacguuugaugccggggaguucagccuccccaccuuugacucccugaacaucacagccgcuagccuuaaugaugacggacuggauaaccacaccauucuccuguauuacucuacagccgcuuccagccuggccgugacccuuaugaucgcgauuuucguuguguauauggucucuagagacaauguguccuguagcaucugccucuga

SEQ ID NO: 210517 - RNA, 1758 nt, Artificial Sequence; identical to SEQ ID NO: 209632
  derived and/or modified sequence opt5 from hemagglutinin__InfluenzaB__AGX21425

SEQ ID NO: 210518 - RNA, 1758 nt, Artificial Sequence
  derived and/or modified sequence opt5 from hemagglutinin__InfluenzaB__AGX21436
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacaacccacuacgucucucaaauuggcggcuucccuaaccagacggaggacgggggacugccccaguccggcagaaucguuguggauuauauggugcaaaagagcgggaaaacaggaaccauuaccuaccagcggggcauccuccugccucagaaggucuggugcgccucugggcgcuccaaagugauuaagggaagccuuccccugaucggcgaagcugacugucuccaugagaaauauggcgggcugaauaaguccaagcccuacuacacaggagagcacgccaaagcgaucggcaacugcccuauuuggguuaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcugucgcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaagguugacgaccuuagagccgauaccaucuccagccaaauugagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacaguggcuucuucccuugccgucacccucaugaucgcgaucuucgugguuuauauggugagcagagauaacgucucuuguuccauuugccuguga

SEQ ID NO: 210519 - RNA, 1758 nt, Artificial Sequence; identical to SEQ ID NO: 209707
  derived and/or modified sequence opt5 from hemagglutinin__InfluenzaB__AGX21447

SEQ ID NO: 210520 - RNA, 1758 nt, Artificial Sequence; identical to SEQ ID NO: 209632
  derived and/or modified sequence opt5 from hemagglutinin__InfluenzaB__AGX21458

SEQ ID NO: 210521 - RNA, 1758 nt, Artificial Sequence; identical to SEQ ID NO: 209632
  derived and/or modified sequence opt5 from hemagglutinin__InfluenzaB__AGX21469

SEQ ID NO: 210522 - RNA, 1758 nt, Artificial Sequence
  derived and/or modified sequence opt5 from hemagglutinin__InfluenzaB__AGX21480
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgaagacggacucgauaaucacaccauucugcuguauuacagcacagcugccucuucccuugcggugacccucaugaucgccauuuucguuguguauauggucagcagagacaacgugucuuguuccaucugccuguga

SEQ ID NO: 210523 - RNA, 1758 nt, Artificial Sequence; identical to SEQ ID NO: 209707
  derived and/or modified sequence opt5 from hemagglutinin__InfluenzaB__AGX21491

SEQ ID NO: 210524 - RNA, 1758 nt, Artificial Sequence; identical to SEQ ID NO: 209707
  derived and/or modified sequence opt5 from hemagglutinin__InfluenzaB__AGX21502

SEQ ID NO: 210525 - RNA, 1758 nt, Artificial Sequence; identical to SEQ ID NO: 209632
  derived and/or modified sequence opt5 from hemagglutinin__InfluenzaB__AGX21513

SEQ ID NO: 210526 - RNA, 1758 nt, Artificial Sequence; identical to SEQ ID NO: 209669
  derived and/or modified sequence opt5 from hemagglutinin__InfluenzaB__AGX21524

SEQ ID NO: 210527 - RNA, 1758 nt, Artificial Sequence
  derived and/or modified sequence opt5 from hemagglutinin__InfluenzaB__AGX21535
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacucugaaacacagauggccaaacuuuauggggauuccaagccgcagaaguuuaccagcucugcuaauggagugacaacccacuacgucucccaaauuggcggcuucccuaaccagacggaggacgggggacugccccagagcggcagaaucguuguggauuauauggugcagaagucugggaaaacaggaaccauuaccuaccaacggggcauccuccugccucagaaggucuggugcgccuccgggcgcagcaaagugauuaagggaucccuuccccugaucggcgaagcugacugucuccaugagaaauauggcgggcugaacaagucuaagcccuacuacacaggagagcacgccaaagcgaucggcaauugcccuauuuggguuaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgagccacggcgcccacgggguggcugucgcggccgaucucaaguccacccaggaggcuaucaauaaaauuacaaagaaccugaauagccuuucugaacuggaggugaaaaaccuccagcgccuguccggagccauggacgagcugcauaaugaaauccucgagcuggaugaaaagguugacgaccuuagagccgauaccaucagcucucaaauugagcuggcugugcuccugagcaacgaaggcaucauuaauuccgaggacgagcaccuucuggcccucgaacggaaacugaagaagaugcuggggcccucugcggucgagaucggcaacggauguuucgaaacaaaacauaagugcaaucagaccugccucgaucgcauugcugccggcacguuugacgccggggaguucagccugccuaccuuugauucccuuaacaucacagcugccagccugaaugacgauggacucgacaaccacaccauucugcuguauuacucuacagcugccuccagccuugcggugacccucaugaucgccaucuucgucguguauaugguuucuagagauaauguguccuguagcauuugccuguga

SEQ ID NO: 210528 - RNA, 1758 nt, Artificial Sequence; identical to SEQ ID NO: 209669
  derived and/or modified sequence opt5 from hemagglutinin__InfluenzaB__AGX21546

SEQ ID NO: 210529 - RNA, 1758 nt, Artificial Sequence
  derived and/or modified sequence opt5 from hemagglutinin__InfluenzaB__AGX21557
augaaggccaucauugugcugcucauggucguuaccagcaacgcugacagaaucugcacaggcauuacguccucuaauagcccccacguggugaaaaccgccacacagggggaggucaacgugaccggaguuaucacacugaccacaaccccuacgaagucccauuucgcgaaucuuaaaggcaccgaaacacgggggaagcuguguccgaaaugccucaacuguaccgaucuggacguggcucuuggacgccccaagugcacaggcaagauuccuucugccagagucagcauccugcacgaggugcggcccguuaccuccggguguuuuccuaucaugcaugaucgcacgaaaauuagacaacuccccaaucugcugcggggauacgaacacauccgccucucuacacauaacgugauuaaugccgagaacgcuccuggcggcccguauaagaucgggaccagcggauccugccccaaugucacaaacggcaauggguucuuugccaccauggcuugggccgugccuaaaaacgacaagaauaaaaccgcgacaaacccccugacgauugaagugccuuacaucuguaccgagggagaggaucagauuacagucuggggcuuccacagcgacaaugaaacccagauggccaaacuuuauggggauucuaagccccagaaguuuacauccagcgcuaacggaguuaccacgcacuacgugucucaaaucggcggcuucccgaaccagacagaggacgggggacugccucaguccggcagaaucguggucgauuauauggugcaaaagagcgggaaaaccggaaccauuacauaccagcggggcauccuccugccccagaagguuuggugcgccucugggcgcuccaaagugauuaagggaagccuuccucugaucggcgaagcugacugucuccaugagaaauauggcgggcugaauaaguccaagcccuacuacaccggagagcacgccaaagcgauuggcaacugccccaucugggucaagacaccucugaaacucgccaaugggacgaaguauagaccgcccgcuaaacugcuuaaggaacggggauuuuucggcgccaucgcuggguuucuggagggcggaugggaaggcaugauugccggguggcauggauacaccucucacggcgcccacgggguggcuguugcggccgaucucaagagcacacaggaggcuaucaacaaaauuaccaagaaucugaacucccuuagcgaacuggaggugaaaaaucuccagcgccugucuggagccauggacgagcugcauaacgaaauccucgagcuggaugaaaaggucgacgaccuuagagccgauacaauuuccagccaaaucgagcuggcugugcuccugucuaaugaaggcaucauuaacagcgaggacgagcaccuucuggcccucgaacggaaacugaagaagaugcuggggccuuccgcggucgagaucggcaauggauguuucgaaaccaaacauaagugcaaccagacgugccucgaucgcauugcugccggcaccuuugacgccggggaguucucucugcccacauuugauagccuuaauaucaccgcugccucccugaacgacgauggacucgacaaucacacaauucugcuguauuacagcaccgcugccucuucccuugcggugacgcucaugaucgccauuuucguuguguauauggucagcagagauaacgugucuuguuccaucugccuguga

SEQ ID NO: 210530 - RNA, 1758 nt, Artificial Sequence
  derived and/or modified sequence opt5 from hemagglutinin__InfluenzaB__AGX21568
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaugaugcaugaucgcaccaaaaucagacaacucccuaaucugcugcggggauacgaacacauucgccucucuacgcauaacgugaucaaugccgagaacgcuccgggcggccccuauaagauugggacaagcggauccugcccuaaugucaccaacggcaauggguucuuugccacaauggcuugggccgugcccaaaaacgacaagaauaaaaccgcgaccaacccucugacaaucgaagugcccuacauuuguacggagggagaggaucagaucaccgucuggggcuuccacagcgacaaugaaacacagauggccaaacuuuauggggauucuaagccgcagaaguuuaccuccagcgcuaacggaguuacaacccacuacgugucucaaauuggcggcuucccuaaccagacggaggacgggggacugccccaguccggcagaaucguggucgauuauauggugcaaaagagcgggaaaacaggaaccaucaccuaccagcggggcauucuccugccucagaagguuuggugcgccucugggcgcuccaaagugaucaagggaagccuuccccugauuggcgaagcugacugucuccaugagaaauauggcgggcugaauaaguccaagcccuacuacacaggagagcacgccaaagcgaucggcaacugcccuauuugggucaagaccccgcugaaacucgccaaugggacaaaguauagacccccugcuaaacugcuuaaggaacggggauuuuucggcgccaucgcuggguuucuggagggcggaugggaaggcaugaucgccggguggcauggauacacgucucacggcgcccacgggguggcuguugcggccgaucucaagagcacccaggaggcuauuaacaaaaucacaaagaaucugaacucccuuagcgaacuggaggugaaaaaucuccagcgccugucuggagccauggacgagcugcauaacgaaauucucgagcuggaugaaaaggucgacgaccuuagagccgauaccaucuccagccaaauugagcuggcugugcuccugucuaaugaaggcaucaucaacagcgaggacgagcaccuucuggcccucgaacggaaacugaagaagaugcuggggcccuccgcggucgagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggugacccucaugauugccaucuucguuguguauauggucagcagagauaacgugucuuguuccauuugccuguga

SEQ ID NO: 210531 - RNA, 1758 nt, Artificial Sequence; identical to SEQ ID NO: 209632
  derived and/or modified sequence opt5 from hemagglutinin__InfluenzaB__AGX21579

SEQ ID NO: 210532 - RNA, 1758 nt, Artificial Sequence; identical to SEQ ID NO: 209669
  derived and/or modified sequence opt5 from hemagglutinin__InfluenzaB__AGX21590

SEQ ID NO: 210533 - RNA, 1758 nt, Artificial Sequence; identical to SEQ ID NO: 210482
  derived and/or modified sequence opt5 from hemagglutinin__InfluenzaB__AGX21601

SEQ ID NO: 210534 - RNA, 1758 nt, Artificial Sequence; identical to SEQ ID NO: 209669
  derived and/or modified sequence opt5 from hemagglutinin__InfluenzaB__AGX21611

SEQ ID NO: 210535 - RNA, 1758 nt, Artificial Sequence; identical to SEQ ID NO: 210013
  derived and/or modified sequence opt5 from hemagglutinin__InfluenzaB__AGX21622

SEQ ID NO: 210536 - RNA, 1758 nt, Artificial Sequence
  derived and/or modified sequence opt5 from hemagglutinin__InfluenzaB__AGX21633
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaauuuaccuccagcgcuaacggagugacaacccacuacgucucucaaauuggcggcuucccuaaccagacggaggacgggggacugccccaguccggcagaaucguuguggauuauauggugcaaaagagcgggaaaacaggaaccauuaccuaccagcggggcauccuccugccucagaaggucuggugcgccucugggcgcuccaaagugauuaagggaagccuuccccugaucggcgaagcugacugucuccaugagaaauauggcgggcugaauaaguccaagcccuacuacacaggagagcacgccaaagcgaucggcaacugcccuauuuggguuaagaccccgcugaaacucgccaaugggacaaaguauagacccccugcucggcugcuuaaagaacgcggauuuuucggcgccaucgcuggguuucuggagggcggaugggaaggcaugauugccggguggcauggauacacgucucacggcgcccacgggguggcugucgcggccgaucucaagagcacccaggaggcuaucaacaagauuacaaagaaucugaacucccuuagcgaacuggaggugaagaaucuccagagacugucuggagccauggacgagcugcauaacgaaauccucgagcuggaugaaaaaguugacgaccuucgggccgauaccaucuccagccaaauugagcuggcugugcuccugucuaaugaaggcaucauuaacagcgaggacgagcaccuucuggcccucgaacgcaagcugaaaaagaugcuggggcccuccgcggucgagaucggcaauggauguuucgaaacaaagcauaaaugcaaccagaccugccucgauagaauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccaucuucgucguguauaugguuagccgggauaacgugucuuguuccauuugccuguga

SEQ ID NO: 210537 - RNA, 1758 nt, Artificial Sequence; identical to SEQ ID NO: 209707
  derived and/or modified sequence opt5 from hemagglutinin__InfluenzaB__AGX21644

SEQ ID NO: 210538 - RNA, 1758 nt, Artificial Sequence; identical to SEQ ID NO: 209632
  derived and/or modified sequence opt5 from hemagglutinin__InfluenzaB__AGX21655

SEQ ID NO: 210539 - RNA, 1758 nt, Artificial Sequence
  derived and/or modified sequence opt5 from hemagglutinin__InfluenzaB__AGX21666
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccuggauaaaauugcugccggcacguuugacgccggggaguucucucuccccaccuuugauagccugaauaucacagcugccucccuuaacgacgauggacuggacaaucacaccauucuccuguauuacagcacagcugccucuucccuggcggugacccuuaugaucgccauuuucguuguguauauggucagccgcgauaacgugucuuguuccaucugccucuga

SEQ ID NO: 210540 - RNA, 1758 nt, Artificial Sequence; identical to SEQ ID NO: 209707
  derived and/or modified sequence opt5 from hemagglutinin__InfluenzaB__AGX21677

SEQ ID NO: 210541 - RNA, 1758 nt, Artificial Sequence; identical to SEQ ID NO: 209632
  derived and/or modified sequence opt5 from hemagglutinin__InfluenzaB__AGX21688

SEQ ID NO: 210542 - RNA, 1758 nt, Artificial Sequence
  derived and/or modified sequence opt5 from hemagglutinin__InfluenzaB__AGX21699
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaagcuguauggggauucuaagccgcagaaauuuaccuccagcgcuaacggaguuacaacccacuacgugucucaaaucggcggcuucccuaaccagacggaggacgggggacugccccaguccggcagaaucguggucgauuauauggugcagaaaagcgggaaaacaggaaccauuaccuaccaacggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaucucgccaacgggacaaaauauagacccccugcuaagcugcuuaaagaacggggauuuuucggcgccaucgcuggguuucuggagggcggaugggaaggcaugauugccggguggcauggauacacgucucacggcgcccacgggguggcuguugcggccgaucucaagagcacccaggaggcuaucaauaagauuacaaagaaccuuaauucccuuagcgaacuggaggugaagaaccuccagcgccugucuggagccauggacgagcugcauaaugaaauccucgagcuggaugaaaaagucgacgaccuuagagccgauaccauuuccagccaaaucgagcuggcugugcuccugucuaacgaaggcaucauuaauagcgaggacgagcaccuucuggcccucgaacggaagcugaaaaagaugcuggggcccuccgcggucgagaucggcaacggauguuucgaaacaaagcauaaaugcaaucagaccugccucgaucgcauugcugccggcacguuugacgccggggaguucucucugccuaccuuugauagccuuaacaucacagcugccucccugagcgacgauggacucgacaaucacaccauucugcuguauuacucuacagcugccuccagccuugcggugacccucaugaucgccauuuucguuguguauauggucucuagagauaacguguccuguagcaucugccuguga

SEQ ID NO: 210543 - RNA, 1758 nt, Artificial Sequence; identical to SEQ ID NO: 210482
  derived and/or modified sequence opt5 from hemagglutinin__InfluenzaB__AGX21710

SEQ ID NO: 210544 - RNA, 1758 nt, Artificial Sequence; identical to SEQ ID NO: 209707
  derived and/or modified sequence opt5 from hemagglutinin__InfluenzaB__AGX21721

SEQ ID NO: 210545 - RNA, 1755 nt, Artificial Sequence
  derived and/or modified sequence opt5 from hemagglutinin__InfluenzaB__AGX21732
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggaggcccuaugugcguggggauuacacccucugccaaggcuagcauccugcacgaaguccgcccugugaccuccggauguuuucccaucaugcaugauagaacgaagauucggcaacucccuaaucugcugcgcggcuacgagaaaaucagacucucugcccagaacguuauuaaugcugaaaaggccccgggcgggcccuauaaacugggaacaagcggcuccugcccuaacgcgaccagcaagucuggguucuuugccacaauggcuugggccgugccccgggacgauaauaaaaccgcuaccaacccucuuacagucgaggugccccacaucugugccaaugaagaggaccagauuacgguguggggauuccauuccgauaacaagacccagaugaagaaucuguacggcgacagcaacccgcaaaaauuuacaucuuccgcgaaugggaucaccacacacuaugucagccagauuggaggcuucccugaucagaccgaggacggcgggcucccccagucuggacgcaucguuguggauuacauggugcaaaagccuggcaaaacggggacaaucgucuaucagagaggcauucugcuuccccagaagguguggugcgccuccggacggagcaaaguuaucaaggggucccugccccucauuggagaagcugacugucugcacgagaaauacggcggccugaacaagucuaagccuuauuacaccggggaacaugccaaagcuaucggaaacugcccgauuugggugaagacaccccucaaacuggccaauggcaccaaguaccgcccucccgccaaacuucugaaggagagaggguuuuucggagcuaucgcgggcuuucucgaagggggcugggaaggaaugaucgccggcuggcacggguauaccagccauggagcucacggcgucgccguggccgcugaucugaaguccacacaggaggccauuaacaaaaucacgaagaaucuuaacagccugucugaacucgagguuaaaaaucugcaacggcuguccggggcgauggacgaacuccacaacgagauucuggagcuugacgaaaagguggaugaccugcgcgcugauaccaucagcucucagauugagcucgccguccugcuuagcaaugaaggaaucaucaacuccgaggacgaacaucugcucgcccuggagagaaaacugaagaagaugcucggcccuucugcuguggauauugggaauggcuguuucgagacaaaacacaagugcaaccagaccugccuggaccggaucgccgcuggaacauuuaaugccggcgaguucagccuucccaccuuugauucccugaacauuacggcggccagccucaaugacgaugggcuggacaaccauaccauccugcuuuacuauucuacagcugccuccagccucgcugucacccugaugauugccaucuucauuguguacaugaucucucgcgauaauguuuccuguagcaucugccuguga

SEQ ID NO: 210546 - RNA, 1755 nt, Artificial Sequence
  derived and/or modified sequence opt5 from hemagglutinin__InfluenzaB__AGX21743
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcggacccgcgggaagcugugucccgauugccucaacuguacagaccuggauguggcucuuggaagaccuaugugcgucggcaccacacccucugccaaagccagcauucugcacgaagugcggccuguuaccuccggguguuuucccaucaugcaugaccgcacgaagaucagacaacucccuaaucugcugcggggauacgagaacauucgccucucuacacagaaugugaucgaugcugaaaaggcccugggcggcccguauagacuugggaccagcggauccugccccaacgcuacaagcaaaucuggcuucuuugccaccauggcgugggccgucccuaaggacaauaacaaaaaugcuaccaacccccugacaguggaggugccuuacauuuguacggaaggggaggaucagaucaccgucuggggauuccacuccgacaauaagacacagaugaaaaaccucuauggcgauagcaauccccaaaaguuuaccucuuccgccaacgggguuacaacccauuacgugagccagauuggaggcuucccggaccagacggaggauggcgggcugccucagucuggacggaucguggucgacuauauggugcaaaagcccggcaaaacagggaccauuguuuaccagcgcggagugcuucugccucagaaggucuggugcgcuuccggcaaaagcaaggugaucaaagggucccucccccugaucggagaagccgauugucugcacgagaaguauggcggccucaacaaaucuaagcccuacuacaccggggaacacgcgaaggccauuggaaauugcccuaucuggguuaaaacaccgcugaaacuugcuaacggcaccaaguauagacccccugccaagcugcucaaagagcggggguuuuucggagcuauugccggcuuucuggaagggggcugggaaggaaugaucgccggcuggcauggguacacaagccacggagcucauggcguggcggucgccgcugaccuuaaguccacgcaggaggccauuaauaagaucaccaaaaaccugaauagccucucugaacuggaggugaagaaccugcaacgccucuccggggccauggacgaacugcacaaugagauccuugagcuggaugaaaaagucgacgaucucagagcugacacaauuagcucucagaucgagcuggccgugcuucugagcaacgaaggaauuaucaauuccgaggaugaacaccuccuggcgcuggagcggaagcucaaaaagaugcugggccccucugcuguugacauugggaacggcuguuucgagaccaagcauaaaugcaaucagacaugccuugaucgcaucgccgccggaaccuuuaacgcuggcgaguucagccugccuacguuugacucccucaauaucaccgccgcuagccugaacgaugacgggcuggauaaucacacaauucuucucuauuacucuaccgccgcguccagccuggccgugacacugaugcucgcuaucuucauugucuauauggugucuagagacaacguuuccuguagcaucugccuguga

SEQ ID NO: 210547 - RNA, 1755 nt, Artificial Sequence
  derived and/or modified sequence opt5 from hemagglutinin__InfluenzaB__AGX21754
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccggcuaagucccauuucgccaaucuuaaaggcaccaagacgcgggggaaacuguguccuaccugccucaacuguacagaucuggacguugcccuuggaggccccaugugcguggggauuacccccucugcuaaggccagcauccugcacgaaguccgcccugugacauccggauguuuucccaucaugcaugauagaaccaagauucggcaacucccuaaucugcugcgcggcuacgagaaaaucagacucucugcucagaacguuauuaaugccgaaaaggcgccgggcgggcccuauaaacugggaacgagcggcuccugcccuaacgccacaagcaagucuggguucuuugcuaccauggccugggcugugccccgggacgauaauaaaacagccaccaacccucuuaccgucgaggugccccacaucugugcgaaugaagaggaccagauuacaguguggggauuccauuccgauaacaagacgcagaugaagaaucuguacggcgacagcaacccgcaaaaauuuaccucuuccgccaaugggaucacaacccacuaugucagccagauuggaggcuucccugaucagacagaggacggcgggcucccccagucuggacgcaucguuguggauuacauggugcaaaagccuggcaaaaccgggacgaucgucuaucagagaggcauucugcuuccccagaagguguggugcgcuuccggacggagcaaaguuaucaaggggucccugccccucauuggagaagccgacugucugcacgagaaauacggcggccugaacaagucuaagccuuauuacacaggggaacaugcuaaagccaucggaaacugcccgauuugggugaagacaccccucaaacuggccaauggcaccaaguaccgcccucccgcuaaacuucugaaggagagaggguuuuucggagcgaucgccggcuuucucgaagggggcugggaaggaaugaucgcuggcuggcacggguauaccagccauggagcccacggcgucgccguggcugccgaucugaaguccacccaggaggcgauuaacaaaaucacaaagaaucuuaacagccugucugaacucgagguuaaaaaucugcaacggcuguccggggcuauggacgaacuccacaacgagauucuggagcuugacgaaaagguggaugaccugcgcgccgauacgaucagcucucagauugagcucgccguccugcuuagcaaugaaggaaucaucaacuccgaggacgaacaucugcucgcucuggagagaaaacugaagaagaugcucggcccuucugccguggauauugggaauggcuguuucgagaccaaacacaagugcaaccagacaugccuggaccggaucgcugccggaaccuuuaaugcgggcgaguucagccuucccacauuugauucccugaacauuaccgccgcuagccucaaugacgaugggcuggacaaccauacgauccugcuuuacuauucuaccgccgcuuccagccucgccgucacacugaugauugcgaucuucauuguguacaugaucucucgcgauaauguuuccuguagcaucugccuguga

SEQ ID NO: 210548 - RNA, 1755 nt, Artificial Sequence
  derived and/or modified sequence opt5 from hemagglutinin__InfluenzaB__AGX21776
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcauuacccccucugccaaagccagcauccugcaugaagugcggccuguuacauccggguguuuucccaucaugcacgaccgcaccaagauuagacaacucccuaaucugcugcggggauaugagaacauccgccucucuacgcagaaugugauugaugcugaaaaggccccgggcggccccuacagacuggggacaagcggauccugcccuaacgcuaccagcaaaucuggcuucuuugccacaauggcgugggccguccccaaggacaauaacaaaaaugcuaccaacccucuuaccguggaggugcccuaugucuguacagaaggggaggaucagaucacgguuuggggauuccauuccgacaauaagacccagaugaaaaaccuguacggcgauagcaauccgcaaaaguuuacaucuuccgccaacggggugaccacacacuaugugagccagauuggaggcuucccugaccagaccgaggauggcgggcucccccagucuggacggaucgucguggacuacaugguucaaaagccuggcaaaacggggacaauuguguaucagcgcggaguccugcuuccccagaagguguggugcgcuuccggcagaagcaaaguuaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggaaggaaugaucgccggcuggcacggguauaccagccauggagcucacggcgucgcgguggccgcugaccugaaauccacacaggaggccauuaauaagaucacgaagaaccuuaauagccugucugaacucgaggucaaaaaccugcaaagacuguccggggccauggacgaacuccauaaugagauccuggagcuugaugaaaagguggacgaucugcgggcugacaccauuagcucucagaucgagcucgccguucugcuuagcaacgaaggaauuaucaauuccgaggaugaacaucugcucgcgcuggagcgcaaacugaagaaaaugcucggcccuucugcuguggacauugggaacggcuguuucgagacaaagcacaagugcaaucagaccugccuggauagaaucgccgccggaacauuuaacgcuggcgaguucagccuucccaccuuugacucccugaauaucacggccgcuagccucaacgaugacgggcuggauaaucacaccauucugcuuuacuauucuacagccgcguccagccucgccgucacccugaugcuggcuaucuucauuguguacaugguuucucgggacaacguguccuguagcaucugccucuga

SEQ ID NO: 210549 - RNA, 1758 nt, Artificial Sequence; identical to SEQ ID NO: 210003
  derived and/or modified sequence opt5 from hemagglutinin__InfluenzaB__AGX21787

SEQ ID NO: 210550 - RNA, 1755 nt, Artificial Sequence
  derived and/or modified sequence opt5 from hemagglutinin__InfluenzaB__AGX21798
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuaugucuguacggaaggggaggaucagauuaccguuuggggauuccauuccgacaauaagacacagaugaaaaaccuguacggcgauagcaauccgcaaaaguuuaccucuuccgccaacggggugacaacccacuaugugagccagaucggaggcuucccugaccagacggaggauggcgggcucccccagucuggacggauugucguggacuacaugguucaaaagccuggcaaaacagggaccaucguguaucagcgcggaguccugcuuccccagaagguguggugcgcuuccggcagaagcaaaguuauuaaggggucccugccccucaucggagaagccgauugucugcaugagaaauacggcggccugaacaagucuaaaccuuacuauaccggggaacacgcgaaggccaucggaaauugcccgauuugggugaagacaccccucaaacuggcuaacggcaccaaguaccggccucccgccaaacuucugaaggagcgcggguuuuucggagcuaucgccggcuuucucgaagggggcugggaaggaaugauugccggcuggcacggguauacaagccauggagcucacggcgucgcgguggccgcugaccugaaauccacgcaggaggccaucaauaagauuaccaagaaccuuaauagccugucugaacucgaggucaaaaaccugcaaagacuguccggggccauggacgaacuccauaaugagauccuggagcuugaugaaaagguggacgaucugcgggcugacacaaucagcucucagauugagcucgccguucugcuuagcaacgaaggaaucauuaauuccgaggaugaacaucugcucgcgcuggagcgcaaacugaagaaaaugcucggcccuucugcuguggacaucgggaacggcuguuucgagaccaagcacaagugcaaucagacaugccuggauagaauugccgccggaaccuuuaacgcuggcgaguucagccuucccacguuugacucccugaauaucaccgccgcuagccucaacgaugacgggcuggauaaucacacaauccugcuuuacuauucuaccgccgcguccagccucgccgucacacugaugcuggcuauuuucaucguguacaugguuucucgggacaacguguccuguagcauuugccucuga

SEQ ID NO: 210551 - RNA, 1755 nt, Artificial Sequence
  derived and/or modified sequence opt5 from hemagglutinin__InfluenzaB__AGX21809
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuaugucuguacggaaggggaggaucagauuaccguuuggggauuccauuccgacaauaagacacagaugaaaaaccuguacggcgauagcaauccgcaaaaguuuaccucuuccgccaacggggugacaacccacuaugugagccagaucggaggcuucccugaccagacggaggauggcgggcucccccagucuggacggauugucguggacuacaugguucaaaagccuggcaaaacagggaccaucguguaucagcgcggaguccugcuuccccagaagguguggugcgcuuccggcagaagcaaaguuauuaaggggucccugccccucaucggagaagccgauugucugcaugagaaauacggcggccugaacaagucucggccuuacuauaccggggaacacgcgaaagccaucggaaauugcccgauuugggugaagacaccccucaagcuggcuaacggcaccaaauaccgcccucccgccaagcugcugaaagagagaggguuuuucggagcuaucgccggcuuucucgaagggggcugggaaggaaugauugccggcuggcacggguauacaagccauggagcucacggcgucgcgguggccgcugaccugaaguccacgcaggaggccaucaauaaaauuaccaagaaccuuaauagccugucugaacucgaggucaagaaccugcaacggcuguccggggccauggacgaacuccauaaugagauccuggagcuugaugaaaaaguggacgaucugcgcgcugacacaaucagcucucagauugagcucgccguucugcuuagcaacgaaggaaucauuaauuccgaggaugaacaccuucucgcgcuggagagaaagcugaaaaagaugcucggcccuucugcuguggacaucgggaacggcuguuucgagaccaaacacaagugcaaucagacaugccuggaucggauugccgccggaaccuuuaacgcuggcgaguucagccuucccacguuugacucccugaauaucaccgccgcuagccucaacgaugacgggcuggauaaucauacaauccugcuuuacuauucuaccgccgcguccagccucgccgucacacugaugcuggcuauuuucaucguguacaugguuucuagagacaacguguccuguagcauuugccucuga

SEQ ID NO: 210552 - RNA, 1755 nt, Artificial Sequence
  derived and/or modified sequence opt5 from hemagglutinin__InfluenzaB__AGX21820
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaaauaaaagcggcuucuuugccaccauggcgugggccguccccaaggacaacaauaaaaacgcuaccaauccucuuacaguggaggugcccuauauuuguacggaaggggaggaucagaucaccgucuggggauuccauucugacaacaagacacagaugaaaaaucuguacggcgauuccaacccgcaaaaguuuaccagcucugccaacgggguuacaacccacuaugugucccagauuggaggcuucccugaccagacggaggauggcgggcucccccagagcggacggaucguggucgacuacaugaugcaaaagccuggcaaaacagggaccauuguguaucagcgcggaguucugcuuccccagaagguguggugcgcuucuggcagauccaaagucaucaaggggagccugccccucaucggagaagccgauugucugcaugagaaauacggcggccugaauaaguccaaaccuuacuauaccggggaacacgcgaaggccauuggaaacugcccgaucugggugaagacaccccucaaacuggcuaauggcaccaaguaccggccucccgccaaacuucugaaggagcgcggguuuuucggagcuauugccggcuuucucgaagggggcugggaaggaaugaucgccggcuggcacggguauacaucucauggagcucacggcguugcgguggccgcugaccugaaaagcacgcaggaggccauuaacaagaucaccaagaaucuuaacucccugagcgaacucgaggucaaaaaucugcaaagacugucuggggccauggacgaacuccauaacgagauccuggagcuugaugaaaagguggacgaucugcgggcugacacaauuuccagccagaucgagcucgccguccugcuuucuaaugaaggaauuaucaacagcgaggaugaacaucugcucgcgcuggagcgcaaacugaagaaaaugcucggcccuuccgcuguggacauugggaauggcuguuucgagaccaagcacaagugcaaccagacaugccuggauagaaucgccgccggaaccuuuaaugcuggcgaguucucucuucccacguuugacagccugaacaucaccgccgcuucccucaaugaugacgggcuggauaaccacacaauucugcuuuacuauagcaccgccgcgucuucccucgccguuacacugaugcuggcuaucuucauuguguacauggucagccgggacaacgugucuuguuccaucugccucuga

SEQ ID NO: 210553 - RNA, 1755 nt, Artificial Sequence; identical to SEQ ID NO: 210047
  derived and/or modified sequence opt5 from hemagglutinin__InfluenzaB__AGX21831

SEQ ID NO: 210554 - RNA, 1755 nt, Artificial Sequence; identical to SEQ ID NO: 210050
  derived and/or modified sequence opt5 from hemagglutinin__InfluenzaB__AGX21842

SEQ ID NO: 210555 - RNA, 1755 nt, Artificial Sequence; identical to SEQ ID NO: 210050
  derived and/or modified sequence opt5 from hemagglutinin__InfluenzaB__AGX21853

SEQ ID NO: 210556 - RNA, 1755 nt, Artificial Sequence
  derived and/or modified sequence opt5 from hemagglutinin__InfluenzaB__AGX21864
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuaaucagaacgugaucgaugcugaaaaggccccgggcggccccuacagacuggggacaagcggauccugcccuaaugcuaccagcaaaucuggcuucuuugccacaauggcgugggccguccccaaggacaacaauaaaaacgcuaccaauccucuuaccguggaggugcccuauauuuguacagaaggggaggaucagaucacggucuggggauuccauuccgacaacaagacccagaugaaaaaucuguacggcgauagcaacccgcaaaaguuuacaucuuccgccaacgggguuaccacacacuaugugagccagauuggaggcuucccugaccagaccgaggauggcgggcucccccagucuggacggaucguggucgacuacaugaugcaaaagccuggcaaaacggggacaauuguguaucagcgcggaguucugcuuccccagaagguguggugcgcuuccggcagaagcaaagucaucaaggggucccugccccucaucggagaagccgauugucugcaugagaaauacggcggccugaauaagucuaaaccuuacuauaccggggaacacgcgaaggccauuggaaacugcccgaucugggugaagacaccccucaaacuggcuaauggcaccaaguaccggccucccgccaaacuucugaaggagcgcggguuuuucggagcuauugccggcuuucucgaagggggcugggaaggaaugaucgccggcuggcacggguauaccagccauggagcucacggcguugcgguggccgcugaccugaaauccacacaggaggccauuaacaagaucacgaagaaucuuaacagccugucugaacucgaggucaaaaaucugcaaagacuguccggggccauggacgaacuccauaacgagauccuggagcuugaugaaaagguggacgaucugcgggcugacaccauuagcucucagaucgagcucgccguccugcuuagcaaugaaggaauuaucaacuccgaggaugaacaucugcucgcgcuggagcgcaaacugaagaaaaugcucggcccuucugcuguggacauugggaauggcuguuucgagacaaagcacaagugcaaccagaccugccuggauagaaucgccgccggaacauuuaaugcuggcgaguucagccuucccaccuuugacucccugaacaucacggccgcuagccucaaugaugacgggcuggauaaccacaccauucugcuuuacuauucuacagccgcguccagccucgccguuacccugaugcuggcuaucuucauuguguacauggucucucgggacaacguguccuguagcaucugccucuga

SEQ ID NO: 210557 - RNA, 1755 nt, Artificial Sequence; identical to SEQ ID NO: 210048
  derived and/or modified sequence opt5 from hemagglutinin__InfluenzaB__AGX21875

SEQ ID NO: 210558 - RNA, 1755 nt, Artificial Sequence; identical to SEQ ID NO: 210047
  derived and/or modified sequence opt5 from hemagglutinin__InfluenzaB__AGX21886

SEQ ID NO: 210559 - RNA, 1755 nt, Artificial Sequence; identical to SEQ ID NO: 210047
  derived and/or modified sequence opt5 from hemagglutinin__InfluenzaB__AGX21897

SEQ ID NO: 210560 - RNA, 1755 nt, Artificial Sequence; identical to SEQ ID NO: 210047
  derived and/or modified sequence opt5 from hemagglutinin__InfluenzaB__AGX21908

SEQ ID NO: 210561 - RNA, 1755 nt, Artificial Sequence
  derived and/or modified sequence opt5 from hemagglutinin__InfluenzaB__AGX21919
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaagcugggacaauuguguaucagcgcggaguucugcuuccccagaagguguggugcgccuccggcagaagcaaagucaucaaggggucccugccccucaucggagaagcggauugucugcaugagaaauacggcggccugaacaagucuaaaccuuacuauaccggggaacacgccaaggcuauuggaaauugcccgaucugggugaagacaccccucaaacuggccaacggcaccaaguaccggccucccgcuaaacuucugaaggagcgcggguuuuucggagccauugccggcuuucucgaagggggcugggaaggaaugaucgcuggcuggcacggguauaccagccauggagcgcacggcguugccguggcugccgaccugaaauccacacaggaggccauuaauaagaucacgaagaaccuuaauagccugucugaacucgaggucaaaaaccugcaaagacuguccggggcuauggacgaacuccauaaugagauccuggagcuugaugaaaagguggacgaucugcgggccgacaccauuagcucucagaucgagcucgcgguccugcuuagcaacgaaggaauuaucaauuccgaggaugaacaucugcucgcucuggagcgcaaacugaagaaaaugcucggcccuucugccguggacauugggaacggcuguuucgagacaaagcacaagugcaaucagaccugccuggauagaaucgccgcuggaacauuuaacgccggcgaguucagccuucccaccuuugacucccugaauaucacggcugccagccucaacgaugacgggcuggauaaucacaccauucugcuuuacuauucuacagcggccuccagccucgcuguuacccugaugcuggccaucuucauuguguacauggucucucgggacaacguguccuguagcaucugccucuga

SEQ ID NO: 210562 - RNA, 1755 nt, Artificial Sequence; identical to SEQ ID NO: 210050
  derived and/or modified sequence opt5 from hemagglutinin__InfluenzaB__AGX21941

SEQ ID NO: 210563 - RNA, 1755 nt, Artificial Sequence; identical to SEQ ID NO: 210047
  derived and/or modified sequence opt5 from hemagglutinin__InfluenzaB__AGX21952

SEQ ID NO: 210564 - RNA, 1755 nt, Artificial Sequence; identical to SEQ ID NO: 210050
  derived and/or modified sequence opt5 from hemagglutinin__InfluenzaB__AGX21963

SEQ ID NO: 210565 - RNA, 1755 nt, Artificial Sequence
  derived and/or modified sequence opt5 from hemagglutinin__InfluenzaB__AGX21974
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggugaauaacaaaaaugcuaccaacccucuuacaguggagguccccuauauuuguacggaaggggaggaccagaucaccguuuggggauuccauuccgauaauaagacacagaugaaaaaccuguacggcgacagcaauccgcaaaaguuuaccucuuccgccaacggggugacaacccacuaugugagccagauuggaucuuucccugaucagacggaggacggcggccucccccaguccgggcggaucgucguggauuacaugaugcaaaagccuggaaaaacaggcaccauuguuuaucagcgcggggugcugcuuccccagaaggucuggugcgcuagcggaagauccaaagugaucaagggcucucugccccucaucggggaagccgacugucugcaugagaaauacggaggccugaacaagagcaaaccuuacuauaccggcgaacacgcgaaggccauugggaauugcccgaucuggguuaagacaccccucaaacuggcuaacggaaccaaguaccggccucccgccaaacuucugaaggagcgcggcuuuuucggggcuauugccggauuucucgagggcgggugggaaggcaugaucgccggauggcacggcuauacaucccauggggcucacggaguggcggucgccgcugaucugaaaagcacgcaggaggccauuaauaagaucaccaagaaccuuaauucucuguccgaacucgaggugaaaaaccugcaaagacugagcggcgccauggacgaacuccauaaugagauccuggagcuugacgaaaaggucgaugaccugcgggcugauacaauuucuagccagaucgagcucgccgugcugcuuuccaacgaagggauuaucaauucugaggacgaacaucugcucgcgcuggagcgcaaacugaagaaaaugcucggaccuagcgcuguugauauuggcaacggguguuucgagaccaagcacaagugcaaucagacaugccuggacagaaucgccgccggcaccuuuaacgcuggagaguucucccuucccacguuugauagccugaauaucaccgccgcuucucucaacgacgauggccuggacaaucacacaauucugcuuuacuauuccaccgccgcgagcucucucgccgugacacugaugcuggcuaucuucauugucuacaugaucucccgggauaacgugagcuguuccauuugccucuga

SEQ ID NO: 210566 - RNA, 1755 nt, Artificial Sequence; identical to SEQ ID NO: 210050
  derived and/or modified sequence opt5 from hemagglutinin__InfluenzaB__AGX21985

SEQ ID NO: 210567 - RNA, 1755 nt, Artificial Sequence; identical to SEQ ID NO: 210048
  derived and/or modified sequence opt5 from hemagglutinin__InfluenzaB__AGX21996

SEQ ID NO: 210568 - RNA, 1755 nt, Artificial Sequence; identical to SEQ ID NO: 210048
  derived and/or modified sequence opt5 from hemagglutinin__InfluenzaB__AGX22007

SEQ ID NO: 210569 - RNA, 1755 nt, Artificial Sequence; identical to SEQ ID NO: 210047
  derived and/or modified sequence opt5 from hemagglutinin__InfluenzaB__AGX22018

SEQ ID NO: 210570 - RNA, 1755 nt, Artificial Sequence; identical to SEQ ID NO: 210047
  derived and/or modified sequence opt5 from hemagglutinin__InfluenzaB__AGX22029

SEQ ID NO: 210571 - RNA, 1755 nt, Artificial Sequence; identical to SEQ ID NO: 210047
  derived and/or modified sequence opt5 from hemagglutinin__InfluenzaB__AGX22040

SEQ ID NO: 210572 - RNA, 1755 nt, Artificial Sequence
  derived and/or modified sequence opt5 from hemagglutinin__InfluenzaB__AGX22051
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagaucgaggauggcgggcucccccagucuggacggauuguggucgacuacaugaugcaaaagccuggcaaaacggggacaaucguguaucagcgcggaguucugcuuccccagaagguguggugcgcuuccggcagaagcaaagucaucaaggggucccugccccucauuggagaagccgauugucugcaugagaaauacggcggccugaacaagucuaaaccuuacuauaccggggaacacgcgaaggccaucggaaauugcccgauuugggugaagacaccccucaaacuggcuaacggcaccaaguaccggccucccgccaaacuucugaaggagcgcggguuuuucggagcuaucgccggcuuucucgaagggggcugggaaggaaugauugccggcuggcacggguauaccagccauggagcucacggcguugcgguggccgcugaccugaaauccacacaggaggccaucaauaagaucacgaagaaccuuaauagccugucugaacucgaggucaaaaaccugcaaagacuguccggggccauggacgcucuccauaaugaaauucuggagcuugaugagaagguggacgaucugcgggccgacaccaucagcucucagauugaacucgcgguccugcuuagcaacgagggaaucauuaauuccgaagaugagcaucugcucgcucuggaacgcaaacugaagaaaaugcucggcccuucugccguggagaucgggaacggcuguuucgagacaaagcacaagugcaaucagaccugccuggacagaaucgccgcuggaacauuuaacgccggcgaguucagccuucccaccuuugauucccugaauauuacggcugccagccucaacgacgaugggcuggacaaucacaccauccugcuuuacuauucuacagcggccuccagccucgcuguuacccugaugcuggccauuuucaucguguacauggucucucgggauaacguguccuguagcauuugccucuga

SEQ ID NO: 210573 - RNA, 1755 nt, Artificial Sequence; identical to SEQ ID NO: 210047
  derived and/or modified sequence opt5 from hemagglutinin__InfluenzaB__AGX22062

SEQ ID NO: 210574 - RNA, 1755 nt, Artificial Sequence
  derived and/or modified sequence opt5 from hemagglutinin__InfluenzaB__AGX22073
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuuaucgaagggggcugggagggaaugauugccggcuggcacggguauacaagccauggagcucacggcguugcgguggccgcugaccucaaauccacgcaggaggccaucaauaagaucaccaagaaccugaauagccuuucugaacuggaggucaaaaaccuccaaagacuguccggggccauggacgaacugcauaaugagauucucgagcuggaugaaaagguggacgaucuucgggcugacacaaucagcucucagauugagcuggccguccuccugagcaacgaaggaaucauuaauuccgaggaugaacaccuucuggcgcucgagcgcaaacugaagaaaaugcugggcccuucugcuguggacaucgggaacggcuguuucgagaccaagcacaagugcaaucagacaugccucgauagaaucgccgccggaaccuuuaacgcuggcgacuucagccugcccacguuugauucccuuaauauuaccgccgcuagccugaacgacgaugggcucgacaaucauacaauccugcuguacuauucuaccgccgcguccagccuugccguuacacucaugcuggcuauuuucaucguguacauggucucucgggacaacguguccuguagcauuugccuguga

SEQ ID NO: 210575 - RNA, 1755 nt, Artificial Sequence; identical to SEQ ID NO: 210050
  derived and/or modified sequence opt5 from hemagglutinin__InfluenzaB__AGX22095

SEQ ID NO: 210576 - RNA, 1755 nt, Artificial Sequence; identical to SEQ ID NO: 210048
  derived and/or modified sequence opt5 from hemagglutinin__InfluenzaB__AGX22106

SEQ ID NO: 210577 - RNA, 1755 nt, Artificial Sequence
  derived and/or modified sequence opt5 from hemagglutinin__InfluenzaB__AGX22128
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaacacagaugaagaaucuguacggcgauagcaacccgcaaaaauuuaccucuuccgccaacggggugacaacccacuaugugagccagaucggaggcuucccugcucagacggaggacggcgggcucccccagucuggacggauugucguggauuacaugguucaaaagccucgcaagacaggcaccaucguguaucagagagggguccugcuuccccagaaaguguggugcgccuccggacggagcaagguuauuaaaggcucccugccccucaucggggaagcggacugucugcaugagaaguacggaggccugaauaaaucuaagccuuacuauaccggcgaacacgccaaagcuaucgggaacugcccgauuugggugaagacaccccucaagcuggccaauggaaccaaauaccgcccucccgcuaagcugcugaaagagagaggcuuuuucggggccaucgccggauuucucgagggcgggugggaaggcaugauugcuggauggcacggcuauacaagccauggggcgcacggagucgccguggcugccgaucugaaguccacgcaggaggccaucaacaaaauuaccaagaaucuuaacagccugucugaacucgagaucaagaaucugcaacggcuguccggcgcuaugaacgaacuccauaaugagauccuggagcuugacgaaaaagucgacgaucugcgcgccgacacaauuagcucucagaucgagcucgcggugcugcuuagcaacgaagggauuaucaauuccgaggaugaacaccuucucgcucuggagagaaagcugaaaaagaugcucggaccuucugccguugacauuggcaacggguguuucgagaccaaacacaagugcaaucagacaugccuggaucggaucgccgcuggcaccuuuaacgccggagaguucagccuucccacguuugacucccugaauaucaccgcugccagccucaacgaugacggccuggauaaccauacaauucugcuuuacuauucuaccgcggccuccagccucgcugugacacugaugcuggccaucuucauugucuacauggugucuagagacaauguuuccuguagcaucugccucuga

SEQ ID NO: 210578 - RNA, 1755 nt, Artificial Sequence
  derived and/or modified sequence opt5 from hemagglutinin__InfluenzaB__AGX22139
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccgaagccagcauucugcaugaggugcggccuguuaccuccggguguuuucccaucaugcacgaccgcacgaaaaucagacaacucccuaaucugcugcggggauaugaaaacauucgccucucuacacagaaugugaucgaugcugagaaggccccgggcggccccuacagacuggggaccagcggauccugcccuaacgcuacaagcaagucuggcuucuuugccaccauggcgugggccguccccaaagacaauaacaagaaugcuaccaacccucuuacaguggaagugcccuauauuuguacggagggggaggaucagaucaccgucuggggauuccauuccgacaauaaaacacagaugaagaaccuguacggcgauagcaauccgcaaaaauuuaccucuuccgccaacgggguuacaacccacuaugugagccagauuggaggcuucccugaccagacggaagauggcgggcucccccagucuggacggaucguggucgacuacaugaugcaaaagccuggcaagacagggaccauuguguaucagcgcggaguucugcuuccccagaaaguguggugcgcuuccggcagaagcaaggucaucaaagggucccugccccucaucggagaggccgauugucugcaugaaaaguacggcggccugaacaaaucuaagccuuacuauaccggggagcacgcgaaagccauuggaaauugcccgaucugggugaagacaccccucaagcuggcuaacggcaccaaauaccggccucccgccaagcugcugaaagagcgcggguuuuucggagcuauugccggcuuucucgaagggggcugggagggaaugaucgccggcuggcacggguauacaagccauggagcucacggcguugcgguggccgcugaccugaaguccacgcaggaagccauuaauaaaaucaccaagaaccuuaauagccugucugagcucgaagucaagaaccugcaaagacuguccggggccauggacgagcuccauaaugagauccuggaacuugaugagaaaguggacgaucugcgggcugacacaauuagcucucagaucgaacucgccguccugcuuagcaacgagggaauuaucaauuccgaagaugagcaccuucucgcgcuggagcgcaagcugaaaaagaugcucggcccuucugcuguggacauugggaacggcuguuucgaaaccaaacacaagugcaaucagacaugccuggauagaaucgccgccggaaccuuuaacgcuggcgaguucagccuucccacguuugacucccugaauaucaccgccgcuagccucaacgaugacgggcuggauaaucauacaauucugcuuuacuauucuaccgccgcguccagccucgccguuacacugaugcuggcuaucuucauuguguacauggucucucgggacaacguguccuguagcaucugccucuga

SEQ ID NO: 210579 - RNA, 1755 nt, Artificial Sequence; identical to SEQ ID NO: 210578
  derived and/or modified sequence opt5 from hemagglutinin__InfluenzaB__AGX22150

SEQ ID NO: 210580 - RNA, 1755 nt, Artificial Sequence; identical to SEQ ID NO: 210578
  derived and/or modified sequence opt5 from hemagglutinin__InfluenzaB__AGX22161

SEQ ID NO: 210581 - RNA, 1755 nt, Artificial Sequence; identical to SEQ ID NO: 210047
  derived and/or modified sequence opt5 from hemagglutinin__InfluenzaB__AGX22172

SEQ ID NO: 210582 - RNA, 1755 nt, Artificial Sequence; identical to SEQ ID NO: 210578
  derived and/or modified sequence opt5 from hemagglutinin__InfluenzaB__AGX22183

SEQ ID NO: 210583 - RNA, 1755 nt, Artificial Sequence; identical to SEQ ID NO: 210578
  derived and/or modified sequence opt5 from hemagglutinin__InfluenzaB__AGX22194

SEQ ID NO: 210584 - RNA, 1755 nt, Artificial Sequence; identical to SEQ ID NO: 210578
  derived and/or modified sequence opt5 from hemagglutinin__InfluenzaB__AGX22205

SEQ ID NO: 210585 - RNA, 1755 nt, Artificial Sequence; identical to SEQ ID NO: 210048
  derived and/or modified sequence opt5 from hemagglutinin__InfluenzaB__AGX22216

SEQ ID NO: 210586 - RNA, 1755 nt, Artificial Sequence; identical to SEQ ID NO: 210050
  derived and/or modified sequence opt5 from hemagglutinin__InfluenzaB__AGX22227

SEQ ID NO: 210587 - RNA, 1755 nt, Artificial Sequence
  derived and/or modified sequence opt5 from hemagglutinin__InfluenzaB__AGX22238
augaaggccaucauugugcugcucauggucguuaccagcaacgcugacagaaucugcacaggcauuacguccucuaauagcccccacauggugaaaaccgccacacagggggaggugaacgucaccggagugaucccucugacaaccacaccgaccaaguccuacuucgcgaaucuuaaaggcacgcggacccgcgggaagcugugucccgauugccucaacuguacagaccuggauguugcucuuggaagaccuaugugcgugggcaccacacccucugccaaagccagcauucugcaugaaguccggccugugaccuccggguguuuucccaucaugcacgaccgcacgaagaucagacaacucccuaaucugcugcggggauaugagaacauucgccucucuacacagaauguuaucgaugcugaaaaggccccgggcggccccuacagacuggggaccagcggauccugcccuaacgcuacaagcaaaucuggcuucuuugccaccauggcgugggccgugcccaaggacaauaacaaaaaugcuaccaacccucuuacagucgaggugcccuauauuuguacggaaggggaggaucagaucaccguguggggauuccauuccgacaauaagacacagaugaaaaaccuguacggcgauagcaauccgcaaaaguuuaccucuuccgccaacggggucacaacccacuauguuagccagauuggaggcuucccugaccagacggaggauggcgggcucccccagucuggacggaucgugguggacuacaugaugcaaaagccuggcaaaacagggaccauugucuaucagcgcggagugcugcuuccccagaagguuuggugcgcuuccggcagaagcaaagugaucaaggggucccugccccucaucggagaagccgauugucugcaugagaaauacggcggccugaacaagucuaaaccuuacuauaccggggaacacgcgaaggccauuggaaauugcccgaucugggucaagacaccccucaaacuggcuaacggcaccaaguaccggccucccgccaaacuucugaaggagcgcggguuuuucggagcuauugccggcuuucucgaagggggcugggaaggaaugaucgccggcuggcacggguauacaagccauggagcucacggcguggcgguugccgcugaccugaaauccacgcaggaggccauuaauaagaucaccaagaaccuuaauagccugucugaacucgaggugaaaaaccugcaaagacuguccggggccauggacgaacuccauaaugagauccuggagcuugaugaaaaggucgacgaucugcgggcugacacaauuagcucucagaucgagcucgccgugcugcuuagcaacgaaggaauuaucaauuccgaggaugaacaucugcucgcgcuggagcgcaaacugaagaaaaugcucggcccuucugcugucgacauugggaacggcuguuucgagaccaagcacaagugcaaucagacaugccuggauagaaucgccgccggaaccuuuaacgcuggcgaguucagccuucccacguuugacucccugaauaucaccgccgcuagccucaacgaugacgggcuggauaaucacacaauucugcuuuacuauucuaccgccgcguccagccucgccgugacacugaugcuggcuaucuucauuguuuacauggugucucgggacaacgucuccuguagcaucugccucuga

SEQ ID NO: 210588 - RNA, 1755 nt, Artificial Sequence; identical to SEQ ID NO: 210048
  derived and/or modified sequence opt5 from hemagglutinin__InfluenzaB__AGX22249

SEQ ID NO: 210589 - RNA, 1755 nt, Artificial Sequence; identical to SEQ ID NO: 210047
  derived and/or modified sequence opt5 from hemagglutinin__InfluenzaB__AGX22260

SEQ ID NO: 210590 - RNA, 1755 nt, Artificial Sequence
  derived and/or modified sequence opt5 from hemagglutinin__InfluenzaB__AGX22271
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccuagcgccaaacuucugaaggagcgcggguuuuucggagcuauugccggcuuucucgaagggggcugggagggaaugaucgccggcuggcacggguauacaucccauggagcucacggcguugcgguggccgcugaccugaaaagcacgcaggaggccauuaauaagaucaccaagaaccuuaauucucuguccgaacucgaggucaaaaaccugcaaagacugagcggggccauggacgaacuccauaaugagauccuggagcuugaugaaaagguggacgaucugcgggcugacacaauuucuagccagaucgagcucgccguccugcuuuccaacgaaggaauuaucaauucugaggaugaacaucugcucgcgcuggagcgcaaacugaagaaaaugcucggccccagcgcuguggagauugggaacggcuguuucgaaaccaagcacaagugcaaucagacaugccuggacagaaucgccgccggaaccuuuaacgcuggcgaguucucccuuccuacguuugauagccugaauaucaccgccgcuucucucaacgacgaugggcuggacaaucacacaauucugcuuuacuauuccaccgccgcgagcucucucgccguuacacugaugcuggcuaucuucauuguguacauggucucccgggauaacgugagcuguuccaucugccucuga

SEQ ID NO: 210591 - RNA, 1755 nt, Artificial Sequence
  derived and/or modified sequence opt5 from hemagglutinin__InfluenzaB__AGX22282
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggagacuucccugaucagacggaggacggcggccucccccagucugggcggaucguggucgauuacaugaugcaaaagccuggaaaaacaggcaccauuguguaucagcgcgggguucugcuuccccagaagguguggugcgcuuccggaagaagcaaagucaucaagggcucccugccccucaucggggaagccgacugucugcaugagaaauacggaggccugaacaagucuaaaccuuacuauaccggcgaacacgcgaaggccauugggaauugcccgaucugggugaagacaccccucaaacuggcuaacggaaccaaguaccggccucccgccaaacuucugaaggagcgcggcuuuuucggggcuauugccggauuucucgagggcgggugggaaggcaugaucgccggauggcacggcuauacaagccauggggcucacggaguugcgguggccgcugaccugaaauccacgcaggaggccauuaauaagaucaccaagaaccuuaauagccugucugaacucgaggucaaaaaccugcaaagacuguccggcgccauggaugaacuccauaaugagauccuggagcuugacgaaaagguggaugaccugcgggcugauacaauuagcucucagaucgagcucgccguccugcuuagcaacgaagggauuaucaauuccgaggacgaacaucugcucgcgcuggagcgcaaacugaagaaaaugcucggaccuucugcuguggauauuggcaacggguguuucgagaccaagcacaagugcaaucagacaugccuggacagaaucgccgccggcaccuuuaacgcuggagaguucagccuucccacguuugauucccugaauaucaccgccgcuagccucaacgacgauggccuggacaaucacacaauucugcuuuacuauucuaccgccgcguccagccucgccguuacacugaugcuggcuaucuucauuguguacauggucucucgggacaacguguccuguagcaucugccucuga

SEQ ID NO: 210592 - RNA, 1755 nt, Artificial Sequence; identical to SEQ ID NO: 210047
  derived and/or modified sequence opt5 from hemagglutinin__InfluenzaB__AGX22293

SEQ ID NO: 210593 - RNA, 1755 nt, Artificial Sequence
  derived and/or modified sequence opt5 from hemagglutinin__InfluenzaB__AGX22304
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccacaaacgggguuaccacgcacuaugugagccagauuggaggcuucccugaccagacagaggauggcgggcucccccagucuggacggaucguggucgacuacaugaugcaaaagccuggcaaaaccgggaccauuguguaucagcgcggaguucugcuuccccagaagguguggugcgccuccggcagaagcaaagucaucaaggggucccugccccucaucggagaagcugauugucugcaugagaaauacggcggccugaacaagucuaaaccuuacuauacaggggaacacgccaaggcgauuggaaauugcccgaucugggugaagacaccccucaaacuggccaacggcaccaaguaccggccucccgcuaaacuucugaaggagcgcggguuuuucggagccauugcuggcuuucucgaagggggcugggaaggaaugaucgccggcuggcacggguauacgagccauggagcccacggcguugcuguggcggccgaccugaaauccacccaggaggcuauuaauaagaucacaaagaaccuuaauagccugucugaacucgaggucaaaaaccugcaaagacuguccggggccauggacgaacuccauaaugagauccuggagcuugaugaaaagguggacgaucugcgggccgacaccauuagcucucagaucgagcucgcuguccugcuuagcaacgaaggaauuaucaauuccgaggaugaacaucugcucgcccuggagcgcaaacugaagaaaaugcucggcccuucugcgguggacauugggaacggcuguuucgagacaaagcacaagugcaaucagaccugccuggauagaaucgcugccggaacguuuaacgccggcgaguucagccuucccaccuuugacucccugaauaucacagcugccagccucaacgaugacgggcuggauaaucacaccauucugcuuuacuauucuacagcugccuccagccucgcgguuacccugaugcuggccaucuucauuguguacauggucucucgggacaacguguccuguagcaucugccucuga

SEQ ID NO: 210594 - RNA, 1755 nt, Artificial Sequence; identical to SEQ ID NO: 210047
  derived and/or modified sequence opt5 from hemagglutinin__InfluenzaB__AGX22315

SEQ ID NO: 210595 - RNA, 1755 nt, Artificial Sequence; identical to SEQ ID NO: 209450
  derived and/or modified sequence opt5 from hemagglutinin__InfluenzaB__AGX22326

SEQ ID NO: 210596 - RNA, 1755 nt, Artificial Sequence; identical to SEQ ID NO: 210050
  derived and/or modified sequence opt5 from hemagglutinin__InfluenzaB__AGX22337

SEQ ID NO: 210597 - RNA, 1755 nt, Artificial Sequence; identical to SEQ ID NO: 210050
  derived and/or modified sequence opt5 from hemagglutinin__InfluenzaB__AGX22348

SEQ ID NO: 210598 - RNA, 1755 nt, Artificial Sequence
  derived and/or modified sequence opt5 from hemagglutinin__InfluenzaB__AGX22359
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaacacagaugaagaaucuguacggcgauagcaacccgcaaaaauuuaccucuuccgccaacggggugacaacccacuaugugagccagaucggaggcuucccugcucagacggaggacggcgggcucccccagucuggacggauugucguggauuacaugguucaaaagccuaagaaaacaggcaccaucguguaucagcgcgggguccugcuuccccagaagguguggugcgccuccggaagaagcaaaguuauuaagggcucccugccccucaucggggaagcggacugucugcaugagaaauacggaggccugaauaagucuaaaccuuacuauaccggcgaacacgccaaggcuaucgggaacugcccgauuugggugaagacaccccucaaacuggccaauggaaccaaguaccggccucccgcuaaacuucugaaggagcgcggcuuuuucggggccaucgccggauuucucgagggcgggugggaaggcaugauugcuggauggcacggcuauacaagccauggggcgcacggagucgccguggcugccgaucugaaauccacgcaggaggccaucaacaagauuaccaagaaucuuaacagccugucugaacucgagaucaaaaaucugcaaagacuguccggcgcuauggacgaacuccauaacgagauccuggagcuugacgaaaaggucgaugaccugcgggccgauacaauuagcucucagaucgagcucgcggugcugcuuagcaaugaagggauuaucaacuccgaggacgaacaucugcucgcucuggagcgcaaacugaagaaaaugcucggaccuucugccguugauauuggcaauggguguuucgagaccaagcacaagugcaaccagacaugccuggacagaaucgccgcuggcaccuuuaaugccggagaguucagccuucccacguuugauucccugaacaucaccgcugccagccucaaugacgauggccuggacaaccacacaauucugcuuuacuauucuaccgcggccuccagccucgcugugacacugaugcuggccaucuucauugucuacauggugucucgggauaacguuuccuguagcaucugccucuga

SEQ ID NO: 210599 - RNA, 1755 nt, Artificial Sequence; identical to SEQ ID NO: 210048
  derived and/or modified sequence opt5 from hemagglutinin__InfluenzaB__AGX22370

SEQ ID NO: 210600 - RNA, 1755 nt, Artificial Sequence
  derived and/or modified sequence opt5 from hemagglutinin__InfluenzaB__AGX22381
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucucuaaucugcugcggggauaugagaacauucgccucagcacacagaaugugaucgaugcugaaaaggccccuggcggcccguacagacuggggaccuccggaagcugccccaacgcuacaucuaaauccggcuucuuugccaccauggcgugggccgucccuaaggacaauaacaaaaaugcuaccaacccccuuacaguggaggugccuuauauuuguacggaaggggaggaucagaucaccgucuggggauuccauagcgacaauaagacacagaugaaaaaccuguacggcgauucuaauccccaaaaguuuaccuccagcgccaacgggguuacaacccacuaugugucucagauuggaggcuucccggaccagacggaggauggcgggcucccucaguccggacggaucguggucgacuacaugaugcaaaagcccggcaaaacagggaccauuguguaucagcgcggaguucugcuuccucagaagguguggugcgcuagcggcagauccaaagucaucaaggggucucugccccucaucggagaagccgauugucugcaugagaaauacggcggccugaacaagagcaaacccuacuauaccggggaacacgcgaaggccauuggaaauugcccuaucugggugaagacaccgcucaaacuggcuaacggcaccaaguaccggcccccugccaaacuucugaaggagcgcggguuuuucggagcuauugccggcuuucucgaagggggcugggaaggaaugaucgccggcuggcacggguauacaucccauggagcucacggcguugcgguggccgcugaccugaaaagcacgcaggaggccauuaauaagaucaccaagaaccuuaauucucuguccgaacucgaggucaaaaaccugcaaagacugagcggggccauggacgaacuccauaaugagauccuggagcuugaugaaaagguggacgaucugcgggcugacacaauuucuagccagaucgagcucgccguccugcuuuccaacgaaggaauuaucaauucugaggaugaacaucugcucgcgcuggagcgcaaacugaagaaaaugcucggccccagcgcuguggacauugggaacggcuguuucgagaccaagcacaagugcaaucagacaugccuggauagaaucgccgccggaaccuuuaacgcuggcgaguucucccuuccuacguuugacagccugaauaucaccgccgcuucucucaacgaugacgggcuggauaaucacacaauucugcuuuacuauuccaccgccgcgagcucucucgccguuacacugaugcuggcuaucuucauuguguacauggucucccgggacaacgugagcuguuccaucugccucuga

SEQ ID NO: 210601 - RNA, 1755 nt, Artificial Sequence; identical to SEQ ID NO: 210047
  derived and/or modified sequence opt5 from hemagglutinin__InfluenzaB__AGX22392

SEQ ID NO: 210602 - RNA, 1755 nt, Artificial Sequence
  derived and/or modified sequence opt5 from hemagglutinin__InfluenzaB__AGX22403
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggagggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcaaagacuguccggggccauggacgaacuccauaaugagauccuggagcuugaugaaaagguggacgaucugcgggcugacacaauuagcucucagaucgagcucgccguccugcuuagcaacgaaggaauuaucaauuccgaggaugaacaucugcucgcgcuggagcgcaaacugaagaaaaugcucggcccuucugcuguggacauugggaacggcuguuucgagaccaagcacaagugcaaucagacaugccuggauagaaucgccgccggaaccuuuaacgcuggcgacuucagccuucccacguuugauucccugaauaucaccgccgcuagccucaacgacgaugggcuggacaaucacacaauucugcuuuacuauucuaccgccgcguccagccucgccguuacacugaugcuggcuaucuucauuguguacauggucucucgggacaacguguccuguagcaucugccucuga

SEQ ID NO: 210603 - RNA, 1755 nt, Artificial Sequence; identical to SEQ ID NO: 210047
  derived and/or modified sequence opt5 from hemagglutinin__InfluenzaB__AGX22414

SEQ ID NO: 210604 - RNA, 1755 nt, Artificial Sequence
  derived and/or modified sequence opt5 from hemagglutinin__InfluenzaB__AGX22425
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagauucagaugaaaaaccuguacggcgauagcaauccgcaaaaguuuacaucuuccgccaacgggguuaccacacacuaugugagccagaucggaggcuucccugaccagaccgaggauggcgggcucccccagucuggacggauuguggucgacuacaugaugcaaaagccuggcaaaacggggacaaucguguaucagcgcggaguucugcuuccccagaagguguggugcgcuuccggcagaagcaaagucaucaaggggucccugccccucauuggagaagccgauugucugcaugagaaauacggcggccugaacaagucuaaaccuuacuauaccggggaacacgcgaaggccaucggaaauugcccgauuugggugaagacaccccucaaacuggcuaacggcaccaaguaccggccucccgccaaacuucugaaggagcgcggguuuuucggagcuaucgccggcuuucucgaagggggcugggagggaaugauugccggcuggcacggguauaccagccauggagcucacggcguugcgguggccgcugaccugaaauccacacaggaggccaucaauaagaucacgaagaaccuuaauagccugucugaacucgaggucaaaaaccugcaaagacuguccggggccauggacgaacuccauaaugagauucuggagcuugaugaaaagguggacgaucugcgggcugacaccaucagcucucagauugagcucgccguccugcuuagcaacgaaggaaucauuaauuccgaggaugaacaucugcucgcgcuggagcgcaaacugaagaaaaugcucggcccuucugcuguggagaucgggaacggcuguuucgaaacaaagcacaagugcaaucagaccugccuggacagaaucgccgccggaacauuuaacgcuggcgaguucagccuucccaccuuugauucccugaauauuacggccgcuagccucaacgacgaugggcuggacaaucacaccauccugcuuuacuauucuacagccgcguccagccucgccguuacccugaugcuggcuauuuucaucguguacauggucucucgggauaacguguccuguagcauuugccucuga

SEQ ID NO: 210605 - RNA, 1755 nt, Artificial Sequence; identical to SEQ ID NO: 210048
  derived and/or modified sequence opt5 from hemagglutinin__InfluenzaB__AGX22436

SEQ ID NO: 210606 - RNA, 1755 nt, Artificial Sequence; identical to SEQ ID NO: 210048
  derived and/or modified sequence opt5 from hemagglutinin__InfluenzaB__AGX22445

SEQ ID NO: 210607 - RNA, 1755 nt, Artificial Sequence
  derived and/or modified sequence opt5 from hemagglutinin__InfluenzaB__AGX22456
augaaggccaucauugugcugcucauggucguuaccagcaacgcugacagaaucugcacaggcauuacguccucuagcucuccccacguggugaaaaccgccacacagggggaggucaaugugaccggaguuaucccucugacaaccacaccgaccaaguccuacuucgcgaaccuuaaaggcacgcggacccgcgggaagcugugucccgauugccucaauuguacagaccuggauguggcucuuggaagaccuaugugcgucggcaccacacccagcgccaaagccuccauucugcaugaagugcggccuguuaccucuggguguuuucccaucaugcacgaccgcacgaagaucagacaacucccuaaccugcugcggggauaugagaauauucgccucagcacacagaacgugaucgaugcugaaaaggccccgggcggccccuacagacuggggaccuccggaagcugcccuaaugcuacaucuaaauccggcuucuuugccaccauggcgugggccguccccaaggacaacaauaaaaacgcuaccaauccucuuacaguggaggugcccuauauuuguacggaaggggaggaucagaucaccgucuggggauuccauagcgacaacaagacacagaugaaaaaucuguacggcgauucuaacccgcaaaaguuuaccuccagcgccaaugggguuacaacccacuaugugucucagauuggaggcuucccugaccagacggaggauggcgggcucccccaguccggacggaucguggucgacuacaugaugcaaaagccuggcaaaacagggaccauuguguaucagcgcggaguucugcuuccccagaagguguggugcgcuagcggcagauccaaagucaucaaggggucucugccccucaucggagaagccgauugucugcaugagaaauacggcggccugaacaagagcaaaccuuacuauaccggggaacacgcgaaggccauuggaaacugcccgaucugggugaagacaccccucaaacuggcuaauggcaccaaguaccggccucccgccaaacuucugaaggagcgcggguuuuucggagcuauugccggcuuucucgaagggggcugggaaggaaugaucgccggcuggcacggguauacaucccauggagcucacggcguugcgguggccgcugaccugaaaagcacgcaggaggccauuaacaagaucaccaagaaucuuaacucucuguccgaacucgaggucaaaaaucugcaaagacugagcggggccauggacgaacuccauucugagauccuggagcuugaugaaaagguggacgaucugcgggcugacacaauuagcucccagaucgagcucgccguccugcuuucuaacgaaggaauuaucaauagcgaggaugaacaucugcucgcgcuggagcgcaaacugaagaaaaugcucggcccuuccgcuguggacauugggaacggcuguuucgagaccaagcacaagugcaaucagacaugccuggauagaaucgccgccggaaccuuuaacgcuggcgaguucagccuucccacguuugacucucugaauaucaccgccgcuucccucaacgaugacgggcuggauaaucacacaauucugcuuuacuauagcaccgccgcgucuucccucgccguuacacugaugcuggcuaucuucauuguguacaucgucagccgggacaacguguccuguucuauuugccucuga

SEQ ID NO: 210608 - RNA, 1755 nt, Artificial Sequence; identical to SEQ ID NO: 210047
  derived and/or modified sequence opt5 from hemagglutinin__InfluenzaB__AGX22467

SEQ ID NO: 210609 - RNA, 1755 nt, Artificial Sequence; identical to SEQ ID NO: 210047
  derived and/or modified sequence opt5 from hemagglutinin__InfluenzaB__AGX22478

SEQ ID NO: 210610 - RNA, 1755 nt, Artificial Sequence
  derived and/or modified sequence opt5 from hemagglutinin__InfluenzaB__AGX22489
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagagcgcuaucgaugccgaaaaggcuccgggcggccccuacagacuggggaccuccggaagcugcccuaaugccacaucuaaauccggcuucuuugcgaccauggccugggcugugcccaaggacaacaauaaaaacgccaccaauccucuuacagucgaggugcccuauauuuguacggaaggggaggaucagaucaccguguggggauuccauagcgacaacaagacacagaugaaaaaucuguacggcgauucuaacccgcaaaaguuuaccuccagcgcuaauggggucacaacccacuauguuucucagauuggaggcuucccuggccagacggaggacgggggacucccccaguccggccggaucgugguggauuacaugauucaaaagccugggaaaacaggaaccaucgucuaucagcgcggcgugcugcuuccccagaagguuuggugcgccagcgggagauccaaagugaucaagggaucucugccccucauuggcgaagcggacugucugcaugagaaauacggcgggcugaacaagagcaaaccuuacuauaccggagaacacgccaaggcuaucggcaacugcccgauuugggucaagacaccccucaaacuggccaaugggaccaaguaccggccucccgcuaaacuucugaaggagcgcggauuuuucggcgccaucgccggguuucucgagggcggaugggaaggcaugauugcuggguggcacggauauacaucccauggcgcgcacgggguggccguugcugccgaucugaaaagcacgcaggaggccaucaacaagaucaccaagaaucuuaacucucuguccgaacucgaggugaaaaaucugcaaagacugagcggagcuauggacgaacuccauaacgagauucuggagcuugacgaaaaggucgaugaccugcgggccgauacaaucucugcgcagauugagcucgcugugcugcuuagcaaugaaggcaucauuaacuccgaggacgaacaucugcucgcccuggagcgcaaacugaagaaaaugcucgggccuucugccgucgauaucggcaauggauguuucgagaccaagcacaagugcaaccagacaugccuggacagaaucgcugccggcaccuuuaaugcuggggaguucagccuucccacguuugauucccugaacauuaccgccgcgagccucaaugacgauggacuggacaaccacacaauccugcuuuacuauucuaccgccgcuuccagccucgccgugacacugaugcuggcuauuuucaucguuuacauggugucucgggauaaugucuccuguagcauuugccucuga

SEQ ID NO: 210611 - RNA, 1755 nt, Artificial Sequence
  derived and/or modified sequence opt5 from hemagglutinin__InfluenzaB__AGX22500
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuauauuuguacggaaggggaggaucagaucaccgucuggggauuccauuccgacaacaaaacacagaugaagaaucuguacggcgauagcaacccgcaaaaauuuaccucuuccgccaacgggguuacaacccacuaugugagccagauuggaggcuucccugcucagacggaggacggcgggcucccccagucuggacggaucauuguggauuacaugguccaaaagccucgcaagacaggcaccaucguguaucagagagggguucugcuuccccagaaaguguggugcgccuccggacggagcaaggucaucaaaggcucccugccccucauuggggaagcggacugucugcaugagaaguacggaggccugaauaaaucuaagccuuacuauaccggcgaacacgccaaagcuaucgggaacugcccgauuugggugaagacaccccucaagcuggccaauggaaccaaauaccgcccucccgcuaagcugcugaaagagagaggcuuuuucggggccaucgccggauuucucgagggcgggugggaaggcaugauugcuggauggcacggcuauacaagccauggggcgcacggaguugccguggcugccgaucugaaguccacgcaggaggccaucaacaaaaucaccaagaaucuuaacagccugucugaacucgaggucaagaaucugcaacggcuguccggcgcuauggacgaacuccauaacgagauucuggagcuugacgaaaaaguggaugaccugcgcgccgauacaaucagcucucagauugagcucgcgguccugcuuagcaaugaagggaucauuaacuccgaggacgaacaccuucucgcucuggagagaaagcugaaaaagaugcucggaccuucugccguggauaucggcaauggguguuucgagaccaaacacaagugcaaccagacaugccuggaccggaucgccgcuggcaccuuuaaugccggagaguucagccuucccacguuugauucccugaacauuaccgcugccagccucaaugacgauggccuggacaaccauacaauccugcuuuacuauucuaccguugcguccagccucgccgugacacugaugcuggcuauuuucaucgucuacauggugucuagagauaacguuuccuguagcauuugccucuga

SEQ ID NO: 210612 - RNA, 1755 nt, Artificial Sequence; identical to SEQ ID NO: 210048
  derived and/or modified sequence opt5 from hemagglutinin__InfluenzaB__AGX22511

SEQ ID NO: 210613 - RNA, 1755 nt, Artificial Sequence
  derived and/or modified sequence opt5 from hemagglutinin__InfluenzaB__AGX22522
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaaagcacuaugugagccagauuggaggcuucccggaccagaccgaggauggcgggcucccucagucuggacggaucguggucgacuacaugaugcaaaaacccggcaagacggggacaauuguguaucagcgcggaguucugcuuccucagaaaguguggugcgccuccggcagaagcaaggucaucaaagggucccugccccucaucggagaagcggauugucugcaugagaaguacggcggccugaacaaaucuaagcccuacuauaccggggaacacgccaaggcuauuggaaauugcccuaucugggugaaaaccccgcucaagcuggccaacggcacaaaauaccggcccccugcuaagcugcugaaagagcgcggguuuuucggagccauugccggcuuucucgaagggggcugggaaggaaugaucgcuggcuggcacggguauaccagccauggagcgcacggcguugccguggcugccgaccugaaguccacacaggaggccauuaauaagaucacgaaaaaccuuaauagccugucugaacucgaggucaagaaccugcaaagacuguccggggcuauggacgaacuccauaaugagauccuggagcuugaugaaaaaguggacgaucugcgggccgacaccauuagcucucagaucgagcucgcgguccugcuuagcaacgaaggaauuaucaauuccgaggaugaacaccuucucgcucuggagcgcaagcugaaaaagaugcucggccccucugccguggacauugggaacggcuguuucgagacaaagcacaaaugcaaucagaccugccuggauagaaucgccgcuggaacauuuaacgccggcgaguucagccuuccuaccuuugacucccugaauaucacggcugccagccucaacgaugacgggcuggauaaucauaccauucugcuuuacuauucuacagcggccuccagccucgcuguuacccugaugcuggccaucuucauuguguacauggucucucgggacaacguguccuguagcaucugccucuga

SEQ ID NO: 210614 - RNA, 1755 nt, Artificial Sequence; identical to SEQ ID NO: 209450
  derived and/or modified sequence opt5 from hemagglutinin__InfluenzaB__AGX22533

SEQ ID NO: 210615 - RNA, 1755 nt, Artificial Sequence; identical to SEQ ID NO: 210062
  derived and/or modified sequence opt5 from hemagglutinin__InfluenzaB__AGX22566

SEQ ID NO: 210616 - RNA, 1755 nt, Artificial Sequence; identical to SEQ ID NO: 210048
  derived and/or modified sequence opt5 from hemagglutinin__InfluenzaB__AGX22577

SEQ ID NO: 210617 - RNA, 1755 nt, Artificial Sequence; identical to SEQ ID NO: 210062
  derived and/or modified sequence opt5 from hemagglutinin__InfluenzaB__AGX22588

SEQ ID NO: 210618 - RNA, 1755 nt, Artificial Sequence; identical to SEQ ID NO: 209450
  derived and/or modified sequence opt5 from hemagglutinin__InfluenzaB__AGX22599

SEQ ID NO: 210619 - RNA, 1755 nt, Artificial Sequence
  derived and/or modified sequence opt5 from hemagglutinin__InfluenzaB__AGX22610
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauccgaauccucaaaaguuuaccagcucugccaacgggguuacaacccacuaugugucccagauuggaggcuuccccgaccagacggaggauggcgggcucccucagagcggacggaucguggucgacuacaugaugcaaaagcccggcaaaacagggaccauuguguaucagcgcggaguucugcuuccccagaagguguggugcgcuucuggcagauccaaagucaucaaggggagccugccucucaucggagaagccgauugucugcaugagaaauacggcggccugaacaaguccaaaccguacuauaccggggaacacgcgaaggccauuggaaauugccccaucugggugaagacaccucucaaacuggcuaacggcaccaaguaccggcccccugccaaacuucugaaggagcgcggguuuuucggagcuauugccggcuuucucgaagggggcugggaaggaaugaucgccggcuggcacggguauacaucucauggagcucacggcguugcgguggccgcugaccugaaaagcacgcaggaggccauuaauaagaucaccaagaaccuuaauucccugagcgaacucgaggucaaaaaccugcaaagacugucuggggccauggacgaacuccauaaugagauccuggagcuugaugaaaagguggacgaucugcgggcugacacaauuuccagccagaucgagcucgccguccugcuuucuaacgaaggaauuaucaauagcgaggaugaacaucugcucgcgcuggagcgcaaacugaagaaaaugcucggccccuccgcuguggacauugggaacggcuguuucgagaccaagcacaagugcaaucagacaugccuggauagaaucgccgccggaaccuuuaacgcuggcgaguucucucuuccgacguuugacagccugaauaucaccgccgcuucccucaacgaugacgggcuggauaaucacacaauucugcuuuacuauagcaccgccgcgucuucccucgccguuacacugaugcuggcuaucuucauuguguacauggucagccgggacaacgugucuuguuccaucugccucuga

SEQ ID NO: 210620 - RNA, 1755 nt, Artificial Sequence
  derived and/or modified sequence opt5 from hemagglutinin__InfluenzaB__AGX22621
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaccgggggagaagaucagaucacggucuggggcuuccauuccgacaauaagacacagaugaaaaaccuguacggggauagcaauccccaaaaguuuaccucuuccgcuaacggaguuacaacccacuaugugagccagauuggcggcuucccggaccagacggaggaugggggacucccucagucuggccggaucguggucgacuacaugaugcaaaagcccgggaaaacaggaaccauuguguaucagcgcggcguucugcuuccucagaagguguggugcgccuccgggagaagcaaagucaucaagggaucccugccccucaucggcgaggcggauugucugcaugaaaaauacggcgggcugaacaagucuaaacccuacuauaccggagagcacgccaaggcuauuggcaauugcccuaucugggugaagacaccgcucaaacuggccaacgggaccaaguaccggcccccugcuaaacuucugaaggaacgcggauuuuucggcgccauugccggguuucucgagggcggaugggagggcaugaucgcuggguggcacggauauacaagccauggcgcgcacgggguugccguggcugccgaccugaaauccacgcaggaagccauuaauaagaucaccaagaaccuuaauagccugucugagcucgaagucaaaaaccugcaaagacuguccggagcuauggacgagcuccauaaugaaauccuggagcuugaugagaagguggacgaucugcgggccgacacaauuagcucucagaucgaacucgcgguccugcuuagcaacgagggcauuaucaauuccgaagaugagcaucugcucgcucuggaacgcaaacugaagaaaaugcucgggcccucugccguggacauuggcaacggauguuucgagaccaagcacaagugcaaucagacaugccuggauagaaucgccgcuggcaccuuuaacgccggggaguucagccuuccuacguuugacucccugaauaucaccgcugccagccucaacgaugacggacuggauaaucacacaauucugcuuuacuauucuaccgcggccuccagccucgcuguuacacugaugcuggccaucuucauuguguacauggucucucgggacaacguguccuguagcaucugccucuga

SEQ ID NO: 210621 - RNA, 1755 nt, Artificial Sequence; identical to SEQ ID NO: 209450
  derived and/or modified sequence opt5 from hemagglutinin__InfluenzaB__AGX22632

SEQ ID NO: 210622 - RNA, 1755 nt, Artificial Sequence
  derived and/or modified sequence opt5 from hemagglutinin__InfluenzaB__AGX22643
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuauccagaaugugauugaugccgaaaaggcuccuggcggcccguacagacuggggacaagcggauccugccccaacgccaccagcaaaucuggcuucuuugcgacaauggccugggcugucccuaaggacaauaacaaaaaugccaccaacccccuuaccguggaggugccuuauaucuguacagaaggggaggaucagauuacggucuggggauuccauuccgacaauaagacccagaugaaaaaccuguacggcgauagcaauccccaaaaguuuacaucuuccgcuaacgggguuaccacacacuaugugagccagaucggaggcuucccggaccagaccgaggauggcgggcucccucagucuggacggauuguggucgacuacaugaugcaaaagcccggcaaaacggggacaaucguguaucagcgcggaguucugcuuccucagaagguguggugcgccuccggcagaagcaaagucaucaaggggucccugccccucauuggagaagcggauugucugcaugagaaauacggcggccugaacaagucuaaacccuacuauaccggggaacacgccaaggcuaucggaaauugcccuauuugggugaagaccccgcucaaacuggccaacggcacaaaguaccggcccccugcuaaacuucugaaggagcgcggguuuuucggagccaucgccggcuuucucgaagggggcugggaaggaaugauugcuggcuggcacggguauaccagccauggagcgcacggcguugccguggcugccgaccugaaauccacacaggaggccaucaauaagaucacgaagaaccuuaauagccugucugaacucgaggucaaaaaccugcaaagacuguccggggcuauggacgaacuccauaaugagauucuggagcuugaugaaaagguggacgaucugcgggccgacaccaucagcucucagauugagcucgcgguccugcuuagcaacgaaggaaucauuaauuccgaggaugaacaucugcucgcucuggagcgcaaacugaagaaaaugcucggccccucugccguggacaucgggaacggcuguuucgagacaaagcacaagugcaaucagaccugccuggauagaaucgccgcuggaacauuuaacgccggcgaguucagccuuccuaccuuugacucccugaauauuacggcugccagccucaacgaugacgggcuggauaaucacaccauccugcuuuacuauucuacagcggccuccagccucgcuguuacccugaugcuggccauuuucaucguguacauggucucucgggacaacguguccuguagcauuugccucuga

SEQ ID NO: 210623 - RNA, 1755 nt, Artificial Sequence
  derived and/or modified sequence opt5 from hemagglutinin__InfluenzaB__AGX22654
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucuaaacccuacuauaccggggaacacgccaaggcuauuggaaauugcccuaucugggugaagacaccgcucaaacuggccaacggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaauccacgcaggaggccauuaauaagaucaccaagaaccuuaauagccugucugaacucgaggucaaaaaccugcaaagacuguccggggcuauggacgaacuccauagcgagauccuggagcuugaugaaaagguggacgaucugcgggccgacacaauuucuagccagaucgagcucgcgguccugcuuuccaaugaaggaauuaucaacucugaggaugaacaucugcucgcucuggagcgcaaacugaagaaaaugcucggccccagcgccguggacauugggaauggcuguuucgagaccaagcacaagugcaaccagacaugccuggauagaaucgccgcuggaaccuuuaaugccggcgaguucucccuuccuacguuugacagccugaacaucaccgcugccucucucaaugaugacgggcuggauaaccacacaauucugcuuuacuauuccaccgcggccagcucucucgcuguuacacugaugcuggccaucuucauuguguacauggucucccgggacaaugugagcuguuccaucugccucuga

SEQ ID NO: 210624 - RNA, 1755 nt, Artificial Sequence; identical to SEQ ID NO: 210062
  derived and/or modified sequence opt5 from hemagglutinin__InfluenzaB__AGX22665

SEQ ID NO: 210625 - RNA, 1755 nt, Artificial Sequence; identical to SEQ ID NO: 210062
  derived and/or modified sequence opt5 from hemagglutinin__InfluenzaB__AGX22676

SEQ ID NO: 210626 - RNA, 1755 nt, Artificial Sequence; identical to SEQ ID NO: 209450
  derived and/or modified sequence opt5 from hemagglutinin__InfluenzaB__AGX22687

SEQ ID NO: 210627 - RNA, 1755 nt, Artificial Sequence; identical to SEQ ID NO: 210062
  derived and/or modified sequence opt5 from hemagglutinin__InfluenzaB__AGX22698

SEQ ID NO: 210628 - RNA, 1755 nt, Artificial Sequence
  derived and/or modified sequence opt5 from hemagglutinin__InfluenzaB__AGX22709
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccgagaaaacaggcaccauuguguaucagcgcgggguucugcuuccucagaagguguggugcgccuccggaagaagcaaagucaucaagggcucccugccccucaucggggaagcggauugucugcaugaaaaauacggaggccugaacaagucuaaacccuacuauaccggcgagcacgccaaggcuauugggaauugcccuaucugggugaagacaccgcucaaacuggccaacggaaccaaguaccggcccccugcuaaacuucugaaggagcgcggcuuuuucggggccauugccggauuucucgaaggcgggugggagggcaugaucgcuggauggcacggcuauacaagccauggggcgcacggaguugccguggcugccgaccugaaauccacgcaggaagccauuaauaagaucaccaagaaccuuaauagccugucugagcucgaagucaaaaaccugcaaagacuguccggcgcuauggacgagcuccauaaugagauccuggaacuugaugagaagguggacgaucugcgggccgacacaauuagcucucagaucgaacucgcgguccugcuuagcaacgaggggauuaucaauuccgaagaugagcaucugcucgcucuggagcgcaaacugaagaaaaugcucggacccucugccguggacauuggcaacggguguuucgaaaccaagcacaagugcaaucagacaugccuggauagaaucgccgcuggcaccuuuaacgccggagaguucagccuuccuacguuugacucccugaauaucaccgcugccagccucaacgaugacggccuggauaaucacacaauucugcuuuacuauucuaccgcggccuccagccucgcuguuacacugaugcuggccaucuucauuguguacauggucucucgggacaacguguccuguagcaucugccucuga

SEQ ID NO: 210629 - RNA, 1755 nt, Artificial Sequence
  derived and/or modified sequence opt5 from hemagglutinin__InfluenzaB__AGX22720
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacggggcuacaacccacuauguuagccagauuggaggcuucccugaccagacggaggauggcgggcucccccagucuggacggaucgugguggacuacaugaugcaaaagccuggcaaaacagggaccauugucuaucagcgcggagugcugcuuccccagaagguuuggugcgccuccggcagaagcaaagugaucaaggggucccugccccucaucggagaagcggauugucugcaugagaaauacggcggccugaacaagucuaaaccuuacuauaccggggaacacgccaaggcuauuggaaauugcccgaucugggucaagacaccccucaaacuggccaacggcaccaaguaccggccucccgcuaaacuucugaaggagcgcggguuuuucggagccauugccggcuuucucgaagggggcugggaaggaaugaucgcuggcuggcacggguauacaagccauggagcgcacggcguggccguugcugccgaccugaaauccacgcaggaggccauuaauaagaucaccaagaaccuuaauagccugucugaacucgaggugaaaaaccugcaaagacuguccggggcuauggacgaacuccauaaugagauccuggagcuugaugaaaaggucgacgaucugcgggccgacacaauuagcucucagaucgagcucgcggugcugcuuagcaacgaaggaauuaucaauuccgaggaugaacaucugcucgcucuggagcgcaaacugaagaaaaugcucggcccuucugccgucgacauugggaacggcuguuucgagaccaagcacaagugcaaucagacaugccuggauagaaucgccgcuggaaccuuuaacgccggcgaguucagccuucccacguuugacucccugaauaucaccgcugccagccucaacgaugacgggcuggauaaucacacaauucugcuuuacuauucuaccgcggccuccagccucgcugugacacugaugcuggccaucuucauuguuuacauggugucucgggacaacgucuccuguagcaucugccucuga

SEQ ID NO: 210630 - RNA, 1755 nt, Artificial Sequence; identical to SEQ ID NO: 210062
  derived and/or modified sequence opt5 from hemagglutinin__InfluenzaB__AGX22731

SEQ ID NO: 210631 - RNA, 1755 nt, Artificial Sequence; identical to SEQ ID NO: 210623
  derived and/or modified sequence opt5 from hemagglutinin__InfluenzaB__AGX22742

SEQ ID NO: 210632 - RNA, 1755 nt, Artificial Sequence
  derived and/or modified sequence opt5 from hemagglutinin__InfluenzaB__AGX22753
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccggcgaaguccuacuucgcuaaucuuaaaggcacccggacgcgcgggaagcugugucccgauugccucaacuguaccgaccuggauguggcccuuggaagaccuaugugcgucggcacaacccccucugccaaagcuagcauucugcaugaagugcggccuguuacauccggguguuuucccaucaugcacgaccgcaccaagaucagacaacucgccaaucugcugcggggauaugagaacauucgccucucuacgcagaaugugaucgaugcugaaaaggccccuggcggcccguacagacuggggacaagcggauccugccccaacgcgaccagcaaaucuggcuucuuugccacaauggcuugggccgucccuaaggacaauaacaaaaaugcuaccaacccccuuaccguggaggugccuuauauuuguaaggaaggggaggaucagaucacagucuggggauuccauuccgacaauaaaacgcagaugaagaaccuguacggcgauagcaauccccaaaaguuuaccucuuccgccaacgggguuacaacccacuaugugagccagauuggaggcuucccggaccagacagaggauggcgggcucccucagucuggacggaucguggucgacuacaugauucaaaaacccggcaagaccgggacgaucguguaucagcgcggaguucugcuuccucagaaaguguggugcgcguccggcagaagcaaggucaucaaagggucccugccccucauuggagaagccgauugucugcaugagaaguacggcggccugaacaaaucuaagcccuacuauacaggggaacacgcuaaggccaucggaaauugcccuauuugggugaaaaccccgcucaagcuggcuaacggcaccaaauaccggcccccugccaaacuucugaaagagcgcggguuuuucggagccaucgcuggcuuucucgaagggggcugggaaggaaugauugcgggcuggcacggguauacaagccauggagcccacggcguugcuguggccgccgaccugaaguccacccaggaggcuaucaauaagaucacaaagaaccuuaauagccugucugaacucgaggucaagaaccugcaaagacuguccggggccauggacgaacuccauaaugagauucuggagcuugaugaaaaaguggacgaucugcgggcggacacgaucagcucucagauugagcucgcuguccugcuuagcaacgaaggaaucauuaauuccgaggaugaacaucugcucgcccuggagcgcaagcugaaaaagaugcucggccccucugccguggacaucgggaacggcuguuucgagaccaagcacaaaugcaaucagacaugccuggauagaaucgcugccggaaccuuuaacgcuggcgaguucagccuuccuacauuugacucccugaauauuaccgccgcgagccucaacgaugacgggcuggauaaucacacgauccugcuuuacuauucuaccgccgcuuccagccucgccguuacacugaugcuggcuauuuucaucguguacauggucucucgggacaacguguccuguagcauuugccucuga

SEQ ID NO: 210633 - RNA, 1755 nt, Artificial Sequence
  derived and/or modified sequence opt5 from hemagglutinin__InfluenzaB__AGX22764
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaaggaaggggaggaucagaucacggucuggggauuccauuccgacaauaaaacccagaugaagaaccuguacggcgauagcaauccccaaaaguuuacaucuuccgcuaacgggguuaccacacacuaugugagccagauuggaggcuucccggaccagaccgaggauggcgggcucccucagucuggacggaucguggucgacuacaugauucaaaaacccggcaagacggggacaaucguguaucagcgcggaguucugcuuccucagaaaguguggugcgccuccggcagaagcaaggucaucaaagggucccugccccucauuggagaagcggauugucugcaugagaaguacggcggccugaacaaaucuaagcccuacuauaccggggaccacgccaaggcuaucggaaauugcccuauuugggugaaaaccccgcucaagcuggccaacggcacaaaauaccggcccccugcuaagcugcugaaagaacgcggguuuuucggagccaucgccggcuuucucgaagggggcugggagggaaugauugcuggcuggcacggguauaccagccauggagcgcacggcguugccguggcugccgaccugaaguccacacaggaggccaucaauaagaucacgaaaaaccuuaauagccugucugagcucgaagucaagaaccugcaaagacuguccggggcuauggaugagcuccauaaugaaauucuggagcuugacgagaaaguggaugaccugcgggccgauaccaucagcucucagauugaacucgcgguccugcuuagcaacgagggaaucauuaauuccgaagacgagcaccuucucgcucuggaacgcaagcugaaaaagaugcucggccccucugccguggauaucgggaacggcuguuucgagacaaagcacaaaugcaaucagaccugccuggacagaaucgccgcuggaacauuuaacgccggcgaguucagccuuccuaccuuugauucccugaauauuacggcugccagccucaacgacgaugggcuggacaaucauaccauccugcuuuacuauucuacagcggccuccagccucgcuguuacccugaugcuggccauuuucaucguguacauggucucucgggacaacguguccuguagcauuugccucuga

SEQ ID NO: 210634 - RNA, 1755 nt, Artificial Sequence
  derived and/or modified sequence opt5 from hemagglutinin__InfluenzaB__AGX22775
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaggcuucccugaccagacggaggauggcgggcucccccagucuggacggaucguggucgacuacaugaugcaaaagccuggcaaaacagggaccauuguguaucagcgcggaguucugcuuccccagaagguguggugcgcuuccggcagaagcaaagucaucaaggggucccugccccucaucggagaagccgauugucugcaugagaaauacggcggccugaacaagucuaaaccuuacuauaccggggaacacgcgaaggccauuggaaauugcccgaucugggugaagacaccccucaaacuggcuaacggcaccaaguaccggccucccgccaaacuucugaaggagcgcggguuuuucggagcuauugccggcuuucucgaagggggcugggagggaaugaucgccggcuggcacggguauacaagccauggagcucacggcguugcgguggccgcugaccugaaauccacgcaggaggccauuaauaagaucaccaagaaccuuaauagccugucugaacucgaggucaaaaaccugcaaagacuguccggggccauggacgaacuccauaaugagauccuggagcuugaugaaaagguggacgaucugcgggcugacacaauuagcucucagaucgagcucgccguccugcuuagcaacgaaggaauuaucaauuccgaggaugaacaucugcucgcgcuggagcgcagacugaaaaagaugcucggcccuucugcuguggagauugggaacggcuguuucgaaaccaaacacaagugcaaucagacaugccuggaccggaucgccgccggaaccuuuaacgcuggcgaguucagccuucccacguuugauucccugaauaucaccgccgcuagccucaacgacgaugggcuggacaaucacacaauucugcuuuacuauucuaccgccgcguccagccucgccguuacacugaugcuggcuaucuucauuguguacauggucucuagagauaacguguccuguagcaucugccucuga

SEQ ID NO: 210635 - RNA, 1755 nt, Artificial Sequence; identical to SEQ ID NO: 210062
  derived and/or modified sequence opt5 from hemagglutinin__InfluenzaB__AGX22786

SEQ ID NO: 210636 - RNA, 1755 nt, Artificial Sequence
  derived and/or modified sequence opt5 from hemagglutinin__InfluenzaB__AGX22797
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaaggaaggggaggaucagaucacggucuggggauuccauuccgacaauaaaacccagaugaagaaccuguacggcgauagcaauccccaaaaguuuacaucuuccgcuaacgggguuaccacacacuaugugagccagauuggaggcuucccggaccagaccgaggauggcgggcucccucagucuggacggaucguggucgacuacaugauucaaaaacccggcaagacggggacaaucguguaucagcgcggaguucuguuuccucagaaaguguggugcgccuccggcagaagcaaggucaucaaagggucccuuccccugauuggagaagcggauugucuccaugagaaguacggcggccugaacaaaucuaagcccuacuauaccggggaacacgccaaggcuaucggaaauugcccuauuugggugaaaaccccgcugaagcucgccaacggcacaaaauaccggcccccugcuaagcugcuuaaagagcgcggguucuuuggagccaucgccggcuuccuggaagggggcugggagggaaugauugcuggcuggcacggguauaccagccauggagcgcacggcguugccguggcugccgaccucaaguccacacaggaggccaucaauaagaucacgaaaaaccugaauagccuuucugaacuggaggucaagaaccuccaaagacuguccggggcuauggacgaacugcauaaugagauucucgagcuggaugaaaaaguggacgaucuucgggccgacaccaucagcucucagauugagcuggcgguccuccugagcaacgaaggaaucauuaauuccgaggaugaacaccuucuggcucucgagcgcaagcugaaaaagaugcugggccccucugccguggacaucgggaacggcuguuuugagacaaagcacaaaugcaaucagaccugccucgauagaaucgccgcuggaacauucaacgccggcgaauuuagccugccuaccuucgacucccuuaauauuacggcugccagccugaacgaugacgggcucgauaaucauaccauccugcuguacuauucuacagcggccuccagccuugcuguuacccucaugcuggccauuuucaucguguacauggucucucgggacaacguguccuguagcauuugccuguga

SEQ ID NO: 210637 - RNA, 1755 nt, Artificial Sequence; identical to SEQ ID NO: 210062
  derived and/or modified sequence opt5 from hemagglutinin__InfluenzaB__AGX22808

SEQ ID NO: 210638 - RNA, 1755 nt, Artificial Sequence; identical to SEQ ID NO: 210062
  derived and/or modified sequence opt5 from hemagglutinin__InfluenzaB__AGX22819

SEQ ID NO: 210639 - RNA, 1755 nt, Artificial Sequence; identical to SEQ ID NO: 210062
  derived and/or modified sequence opt5 from hemagglutinin__InfluenzaB__AGX22830

SEQ ID NO: 210640 - RNA, 1755 nt, Artificial Sequence
  derived and/or modified sequence opt5 from hemagglutinin__InfluenzaB__AGX22841
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaaggaaggggaggaucagaucacggucuggggauuccauuccgacaauaaaacccagaugaagaaccuguacggcgauagcaauccccaaaaguuuacaucuuccgcugacgggguuaccacacacuaugugagccagauuggaggcuucccggaucagaccgaggacggcgggcucccucagucuggacggaucguggucgauuacaugauucaaaaacccggcaagacggggacaaucguguaucagcgcggaguucugcuuccucagaaaguguggugcgccuccggcagaagcaaggucaucaaagggucccugccccucauuggagaagcggacugucugcaugagaaguacggcggccugaacaaaucuaagcccuacuauaccggggaacacgccaaggcuaucggaaacugcccuauuugggugaaaaccccgcucaagcuggccaauggcacaaaauaccggcccccugcuaagcugcugaaagagcgcggguuuuucggagccaucgccggcuuucucgaagggggcugggaaggaaugauugcuggcuggcacggguauaccagccauggagcgcacggcguugccguggcugccgaccugaaguccacacaggaggccaucaacaagaucacgaaaaaucuuaacagccugucugaacucgaggucaagaaucugcaaagacuguccggggcuauggaugaacuccauaacgagauucuggagcuugacgaaaaaguggaugaccugcgggccgauaccaucagcucucagauugagcucgcgguccugcuuagcaaugaaggaaucauuaacuccgaggacgaacaccuucucgcucuggagcgcaagcugaaaaagaugcucggccccucugccguggauaucgggaauggcuguuucgagacaaagcacaaaugcaaccagaccugccuggacagaaucgccgcuggaacauuuaaugccggcgaguucagccuuccuaccuuugauucccugaacauuacggcugccagccucaaugacgaugggcuggacaaccauaccauccugcuuuacuauucuacagcggccuccagccucgcuguuacccugaugcuggccauuuucaucguguacauggucucucgggacaauguguccuguagcauuugccucuga

SEQ ID NO: 210641 - RNA, 1755 nt, Artificial Sequence; identical to SEQ ID NO: 209450
  derived and/or modified sequence opt5 from hemagglutinin__InfluenzaB__AGX22852

SEQ ID NO: 210642 - RNA, 1755 nt, Artificial Sequence; identical to SEQ ID NO: 210062
  derived and/or modified sequence opt5 from hemagglutinin__InfluenzaB__AGX22863

SEQ ID NO: 210643 - RNA, 1755 nt, Artificial Sequence; identical to SEQ ID NO: 210062
  derived and/or modified sequence opt5 from hemagglutinin__InfluenzaB__AGX22874

SEQ ID NO: 210644 - RNA, 1755 nt, Artificial Sequence; identical to SEQ ID NO: 209450
  derived and/or modified sequence opt5 from hemagglutinin__InfluenzaB__AGX22885

SEQ ID NO: 210645 - RNA, 1755 nt, Artificial Sequence; identical to SEQ ID NO: 210623
  derived and/or modified sequence opt5 from hemagglutinin__InfluenzaB__AGX22896

SEQ ID NO: 210646 - RNA, 1755 nt, Artificial Sequence
  derived and/or modified sequence opt5 from hemagglutinin__InfluenzaB__AGX22907
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucuaaacccuacuauaccggggaacacgccaaggcuauuggaaauugcccuaucugggugaagacaccgcucaaacuggccaacggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaauccacgcaggaggccauuaauaagaucaccaagaaccuuaauagccugucugaacucgaggucaaaaaccugcaaagacuguccggggcuauggacgaacuccauaaugagauccuggagcuugaugaaaagguggacgaucugcgggccgacacaauuagcucucagaucgagcucgcgguccugcuuagcaacgaaggaauuaucaauuccgaggaugaacaucugcucgcucuggagcgcaaacugaagaaaaugcucggccccucugccguggacauugggaacggcuguuucgagaccaagcacaagugcaaucagacaugccuggauagaaucgccgcuggaaccuuuaacgccggcgaguucagccuuccuacguuugacucccugaauaucaccgcugccagccucaacgaugacgggcuggauaaucacacaauucugcuuuacuauucuaccgcggccuccagccucgcuguuacacugaugcuggccaucuucauuguguacauggucucucgggacuccgugagcuguuccaucugccucuga

SEQ ID NO: 210647 - RNA, 1755 nt, Artificial Sequence; identical to SEQ ID NO: 209450
  derived and/or modified sequence opt5 from hemagglutinin__InfluenzaB__AGX22918

SEQ ID NO: 210648 - RNA, 1755 nt, Artificial Sequence; identical to SEQ ID NO: 209450
  derived and/or modified sequence opt5 from hemagglutinin__InfluenzaB__AGX22929

SEQ ID NO: 210649 - RNA, 1755 nt, Artificial Sequence; identical to SEQ ID NO: 210062
  derived and/or modified sequence opt5 from hemagglutinin__InfluenzaB__AGX22940

SEQ ID NO: 210650 - RNA, 1755 nt, Artificial Sequence; identical to SEQ ID NO: 209450
  derived and/or modified sequence opt5 from hemagglutinin__InfluenzaB__AGX22951

SEQ ID NO: 210651 - RNA, 1755 nt, Artificial Sequence; identical to SEQ ID NO: 209450
  derived and/or modified sequence opt5 from hemagglutinin__InfluenzaB__AGX22962

SEQ ID NO: 210652 - RNA, 1755 nt, Artificial Sequence; identical to SEQ ID NO: 209450
  derived and/or modified sequence opt5 from hemagglutinin__InfluenzaB__AGX22973

SEQ ID NO: 210653 - RNA, 1755 nt, Artificial Sequence; identical to SEQ ID NO: 209450
  derived and/or modified sequence opt5 from hemagglutinin__InfluenzaB__AGX22984

SEQ ID NO: 210654 - RNA, 1755 nt, Artificial Sequence; identical to SEQ ID NO: 209450
  derived and/or modified sequence opt5 from hemagglutinin__InfluenzaB__AGX22995

SEQ ID NO: 210655 - RNA, 1755 nt, Artificial Sequence; identical to SEQ ID NO: 209450
  derived and/or modified sequence opt5 from hemagglutinin__InfluenzaB__AGX23006

SEQ ID NO: 210656 - RNA, 1755 nt, Artificial Sequence
  derived and/or modified sequence opt5 from hemagglutinin__InfluenzaB__AGX23017
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaaauccggccugugaccuccggguguuuucccaucaugcacgaccgcacgaagauuagacaacucgcuaaucugcugcggggauaugagaacauccgccucucuacacagaauguuauugaugccgaaaaggcuccuggcggcccguacagacuggggaccagcggauccugccccaacgccacaagcaaaucuggcuucuuugcgaccauggccugggcugugccuaaggacaauaacaaaaaugccaccaacccccuuacagucgaggugccuuauaucuguacggaaggggaggaucagauuaccguguggggauuccauuccgacaauaagacacagaugaaaaaccuguacggcgauagcaauccccaaaaguuuaccucuuccgcuaacggggucacaacccacuauguuagccagaucggaggcuucccggaccagacggaggauggcgggcucccucagucuggacggauugugguggacuacaugaugcaaaagcccggcaaaacagggaccaucgucuaucagcgcggagugcugcuuccucagaagguuuggugcgccuccggcagaagcaaagugaucaaggggucccugccccucauuggagaagcggauugucugcaugagaaauacggcggccugaacaagucuaaacccuacuauaccggggaacacgccaaggcuaucggaaauugcccuauuugggucaagacaccgcucaaacuggccaacggcaccaaguaccggcccccugcuaaacuucugaaggagcgcggguuuuucggagccaucgccggcuuucucgaagggggcugggaaggaaugauugcuggcuggcacggguauacaagccauggagcgcacggcguggccguugcugccgaccugaaauccacgcaggaggccaucaauaagaucaccaagaaccuuaauagccugucugaacucgaggugaaaaaccugcaaagacuguccggggcuauggacgaacuccauaaugagauucuggagcuugaugaaaaggucgacgaucugcgggccgacacaaucagcucucagauugagcucgcggugcugcuuagcaacgaaggaaucauuaauuccgaggaugaacaucugcucgcucuggagcgcaaacugaagaaaaugcucggccccucugccgucgacaucgggaacggcuguuucgagaccaagcacaagugcaaucagacaugccuggauagaaucgccgcuggaaccuuuaacgccggcgaguucagccuuccuacguuugacucccugaauauuaccgcugccagccucaacgaugacgggcuggauaaucacacaauccugcuuuacuauucuaccgcggccuccagccucgcugugacacugaugcuggccauuuucaucguuuacauggugucucgggacaacgucuccuguagcauuugccucuga

SEQ ID NO: 210657 - RNA, 1755 nt, Artificial Sequence
  derived and/or modified sequence opt5 from hemagglutinin__InfluenzaB__AGX23028
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguacaagcuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaagaaccuguacggcgauagcaauccccaaaaauuuaccucuuccgcuaacgggguuacaacccacuaugugagccagauuggaggcuucccggaccagacggaggauggcgggcucccucagucuggacgcaucguggucgacuacaugaugcaaaagcccggcaaaacagggaccauuguguaucagagaggaguucugcuuccucagaagguguggugcgccuccggccggagcaaagucaucaaggggucccugccccucaucggagaagcggauugucugcaugagaaauacggcggccugaacaagucuaagcccuacuauaccggggaacacgccaaagcuauuggaaauugcccuaucugggugaagacaccgcucaaacuggccaacggcaccaaguacagacccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaguccacgcaggaggccauuaauaaaaucaccaagaaccuuaauagccugucugaacucgaggucaaaaaccugcaacggcuguccggggcuauggacgaacuccauaaugagauccuggagcuugaugaaaagguggacgaucugcgcgccgacacaauuagcucucagaucgagcucgcgguccugcuuagcaacgaaggaauuaucaauuccgaggaugaacaucugcucgcucuggagagaaaacugaagaagaugcucggccccucugccguggacauugggaacggcuguuucgagaccaaacacaagugcaaucagacaugccuggaucggaucgccgcuggaaccuuuaacgccggcgaguucagccuuccuacguuugacucccugaauaucaccgcugccagccucaacgaugacgggcuggauaaucacacaauucugcuuuacuauucuaccgcggccuccagccucgcuguuacacugaugcuggccaucuucauuguguacauggucucucgcgacaacguguccuguagcaucugccucuga

SEQ ID NO: 210658 - RNA, 1755 nt, Artificial Sequence; identical to SEQ ID NO: 209450
  derived and/or modified sequence opt5 from hemagglutinin__InfluenzaB__AGX23039

SEQ ID NO: 210659 - RNA, 1755 nt, Artificial Sequence
  derived and/or modified sequence opt5 from hemagglutinin__InfluenzaB__AGX23050
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaaguguccccuguuaccucuggguguuuucccaucaugcacgaccggacgaagauccgccaacucgcuaaucugcugagaggauaugagaacauucggcucagcacacagaaugugaucgaugccgaaaaggcuccuggcggcccguaccgccuggggaccuccggaagcugccccaacgccacaucuaaauccggcuucuuugcgaccauggccugggcugucccuaaggacaauaacaaaaaugccaccaacccccuuacaguggaggugccuuauauuuguacggaaggggaggaucagaucaccgucuggggauuccauagcgacaauaagacacagaugaaaaaccuguacggcgauucuaauccccaaaaguuuaccuccagcgcuaacgggguuacaacccacuaugugucucagauuggaggcuucccggaccagacggaggauggcgggcucccucaguccggaagaaucguggucgacuacaugaugcaaaagcccggcaaaacagggaccauuguguaucagcggggaguucugcuuccucagaagguguggugcgccagcggccgcuccaaagucaucaaggggucucugccccucaucggagaagcggauugucugcaugagaaauacggcggccugaacaagagcaaacccuacuauaccggggaacacgccaaggcuauuggaaauugcccuaucugggugaagacaccgcucagacuggccaacggcaccaaauaccggcccccugcuaagcugcugaaagagcgcggguuuuucggagccauugccggcuuucucgaagggggcugggaaggaaugaucgcuggcuggcacggguauacaucccauggagcgcacggcguugccguggcugccgaccuuaagagcacgcaggaggccauuaauaaaaucaccaagaaccuuaauucucuguccgaacucgaggucaagaaccugcaaagacugagcggggcuauggacgaacuccauaaugagauccuggagcuugaugaaaaaguggacgaucugcgggccgacacaauuucuagccagaucgagcucgcgguccugcuuuccaacgaaggaauuaucaauucugaggaugaacaucugcucgcucuggagcgcaagcugaaaaagaugcucggccccagcgccguggacauugggaacggcuguuucgagaccaaacacaagugcaaucagacaugccuggauagaaucgccgcuggaaccuuuaacgccggcgaguucucccuuccuacguuugacagccugaauaucaccgcugccucucucaacgaugacgggcuggauaaucacacaauucugcuuuacuauuccaccgcggccagcucucucgcuguuacacugaugcuggccaucuucauuguguacauggucucccgggacaacgugagcuguuccaucugccucuga

SEQ ID NO: 210660 - RNA, 1755 nt, Artificial Sequence
  derived and/or modified sequence opt5 from hemagglutinin__InfluenzaB__AGX23061
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucuaaacccuacuauaccggggaacacgccaaggcuauuggaaauugcccuaucugggugaagacaccgcuccggcuggccaacggcaccaaauacagacccccugcuaagcugcugaaagagcgcggguuuuucggagccauugccggcuuucucgaagggggcugggaaggaaugaucgcuggcuggcacggguauacaagccauggagcgcacggcguugccguggcugccgaccugaaguccacgcaggaggccauuaauaaaaucaccaagaaccuuaauagccugucugaacucgaggucaagaaccugcaacggcuguccggggcuauggacgaacuccauaaugagauccuggagcuugaugaaaaaguggacgaucugcgcgccgacacaauuagcucucagaucgagcucgcgguccugcuuagcaacgaaggaauuaucaauuccgaggaugaacaccuucucgcucuggagagaaagcugaaaaagaugcucggccccucugccguggacauugggaacggcuguuucgagaccaaacacaagugcaaucagacaugccuggaucggaucgccgcuggaaccuuuaacgccggcgaguucagccuuccuacguuugacucccugaauaucaccgcugccagccucaacgaugacgggcuggauaaucauacaauucugcuuuacuauucuaccgcggccuccagccucgcuguuacacugaugcuggccaucuucauuguguacauggucucuagagacaacguguccuguagcaucugccucuga

SEQ ID NO: 210661 - RNA, 1755 nt, Artificial Sequence; identical to SEQ ID NO: 209450
  derived and/or modified sequence opt5 from hemagglutinin__InfluenzaB__AGX23072

SEQ ID NO: 210662 - RNA, 1755 nt, Artificial Sequence; identical to SEQ ID NO: 210062
  derived and/or modified sequence opt5 from hemagglutinin__InfluenzaB__AGX23083

SEQ ID NO: 210663 - RNA, 1755 nt, Artificial Sequence; identical to SEQ ID NO: 209450
  derived and/or modified sequence opt5 from hemagglutinin__InfluenzaB__AGX23094

SEQ ID NO: 210664 - RNA, 1755 nt, Artificial Sequence; identical to SEQ ID NO: 209450
  derived and/or modified sequence opt5 from hemagglutinin__InfluenzaB__AGX23105

SEQ ID NO: 210665 - RNA, 1755 nt, Artificial Sequence; identical to SEQ ID NO: 210062
  derived and/or modified sequence opt5 from hemagglutinin__InfluenzaB__AGX23116

SEQ ID NO: 210666 - RNA, 1755 nt, Artificial Sequence; identical to SEQ ID NO: 209450
  derived and/or modified sequence opt5 from hemagglutinin__InfluenzaB__AGX23127

SEQ ID NO: 210667 - RNA, 1755 nt, Artificial Sequence; identical to SEQ ID NO: 209450
  derived and/or modified sequence opt5 from hemagglutinin__InfluenzaB__AGX23138

SEQ ID NO: 210668 - RNA, 1755 nt, Artificial Sequence
  derived and/or modified sequence opt5 from hemagglutinin__InfluenzaB__AGX23149
augaaggccaucauugugcugcucauggucguuaccagcaacgcugacagaaucugcacaggcauuacguccucugauagcccccacguggugaaaaccgccacacagggggaggucaaugugaccggaguuaucccucugacaaccacaccgaccaaguccuacuucgcgaaccuuaaaggcacgcggacccgcgggaagcugugucccgacugccucaauuguacagaucuggacguggcucuuggaagaccuaugugcgucggcaccacacccucugccaaagccagcauucugcaugaagugcggccuguuaccuccggguguuuucccaucaugcacgaucgcacgaagaucagacaacucgcuaaccugcugcggggauaugagaauauucgccucucuacacagaacgugaucgacgccgaaaaggcuccuggcggcccguacagacuggggaccagcggauccugccccaaugccacaagcaaaucuggcuucuuugcgaccauggccugggcugucccuaaggauaacaauaaaaacgccaccaauccccuuacaguggaggugccuuauauuuguacggaaggggaggaccagaucaccgucuggggauuccauuccgauaacaagacacagaugaaaaaucuguacggcgacagcaacccccaaaaguuuaccucuuccgcuaaugggguuacaacccacuaugugagccagauuggaggcuucccggaucagacggaggacggcgggcucccucagucuggacggaucguggucgauuacaugaugcaaaagcccggcaaaacagggaccauuguguaucagcgcggaguucugcuuccucagaagguguggugcgccuccggcagaagcaaagucaucaaggggucccugccccucaucggagaagcggacugucugcaugagaaauacggcggccugaacaagucuaaacccuacuauaccggggaacacgccaaggcuauuggaaacugcccuaucugggugaagacaccgcucaaacuggccaauggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaauccacgcaggaggccauuaacaagaucaccaagaaucuuaacagccugucugaacucgaggucaaaaaucugcaaagacuguccggggcuauggaugaacuccauaacgagauccuggagcuugacgaaaagguggaugaccugcgggccgauacaauuagcucucagaucgagcucgcgguccugcuuagcaaugaaggaauuaucaacuccgaggacgaacaucugcucgcucuggagcgcaaacugaagaaaaugcucggccccucugccguggauauugggaauggcuguuucgagaccaagcacaagugcaaccagacaugccuggacagaaucgccgcuggaaccuuuaaugccggcgaguucagccuuccuacguuugauucccugaacaucaccgcugccagccucaaugacgaugggcuggacaaccacacaauucugcuuuacuauucuaccgcggccuccagccucgcuguuacacugaugcuggccaucuucauuguguacauggucucucgggacaauguguccuguagcaucugccucuga

SEQ ID NO: 210669 - RNA, 1755 nt, Artificial Sequence
  derived and/or modified sequence opt5 from hemagglutinin__InfluenzaB__AGX23160
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcauuacccccucugccaaagccagcauccugcaugaagugcggccuguuacauccggguguuuucccaucaugcacgaccgcaccaagauuagacaacucgcuaaucugcugcggggauaugagaacauccgccucucuacgcagaaugugauugaugccgaaaaggcuccuggcggcccguacagacuggggacaagcggauccugccccaacgccaccagcaaaucuggcuucuuugcgacaauggccugggcugucccuaaggacaauaacaaaaaugccaccaacccccuuaccguggaggugccuuauaucuguacagaaggggaggaucagauuacggucuggggauuccauuccgacaauaagacccagaugaaaaaccuguacggcgauagcaauccccaacgguuuacaucuuccgcuaacgggguuaccacacacuaugugagccagaucggaggcuucccggaccagaccgaggauggcgggcucccucagucuggacgcauuguggucgacuacaugaugcaaaagcccggcaagacggggacaaucguguaucagagaggaguucugcuuccucagaaaguguggugcgccuccggccggagcaaggucaucaaagggucccugccccucauuggagaagcggauugucugcaugagaaguacggcggccugaacaaaucuaagcccuacuauaccggggaacacgccaaagcuaucggaaauugcccuauuugggugaagaccccgcuccgccuggccaacggcacaaaguacagacccccugcuaaacuucugaaggagcggggguuuuucggagccaucgccggcuuucucgaagggggcugggaaggaaugauugcuggcuggcacggguauaccagccauggagcgcacggcguugccguggcugccgaccugaaauccacacaggaggccaucaauaagaucacgaaaaaccuuaauagccugucugaacucgaggucaagaaccugcaacgccuguccggggcuauggacgaacuccauaaugagauucuggagcuugaugaaaagguggacgaucugagagccgacaccaucagcucucagauugagcucgcgguccugcuuagcaacgaaggaaucauuaauuccgaggaugaacaucugcucgcucuggagcggaaacugaagaaaaugcucggccccucugccguggacaucgggaacggcuguuucgagacaaagcacaaaugcaaucagaccugccuggauagaaucgccgcuggaacauuuaacgccggcgaguucagccuuccuaccuuugacucccugaauauuacggcugccagccucaacgaugacgggcuggauaaucacaccauccugcuuuacuauucuacagcggccuccagccucgcuguuacccugaugcuggccauuuucaucguguacauggucucucgcgacaacguguccuguagcauuugccucuga

SEQ ID NO: 210670 - RNA, 1755 nt, Artificial Sequence
  derived and/or modified sequence opt5 from hemagglutinin__InfluenzaB__AGX23171
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaacgguuuaccucuuccgcuaacgggguuacaacccacuaugugagccagauuggaggcuucccggaccagacggaggauggcgggcucccucagucuggacgcaucguggucgacuacaugaugcaaaagcccggcaagacagggaccauuguguaucagagaggaguucugcuuccucagaaaguguggugcgccuccggccggagcaaggucaucaaagggucccugccccucaucggagaagcggauugucugcaugagaaguacggcggccugaacaaaucuaagcccuacuauaccggggaacacgccaaagcuauuggaaauugcccuaucugggugaagacaccgcuccgccuggccaacggcaccaaguacagacccccugcuaaacuucugaaggagcggggguuuuucggagccauugccggcuuucucgaagggggcugggaaggaaugaucgcuggcuggcacggguauacaagccauggagcgcacggcguugccguggcugccgaccugaaauccacgcaggaggccauuaauaagaucaccaaaaaccuuaauagccugucugaacucgaggucaagaaccugcaacgccuguccggggcuauggacgaacuccauaaugagauccuggagcuugaugaaaagguggacgaucugagagccgacacaauuagcucucagaucgagcucgcgguccugcuuagcaacgaaggaauuaucaauuccgaggaugaacaucugcucgcucuggagcggaaacugaagaaaaugcucggccccucugccguggacauugggaacggcuguuucgagaccaagcacaaaugcaaucagacaugccuggauagaaucgccgcuggaaccuuuaacgccggcgaguucagccuuccuacguuugacucccugaauaucaccgcugccagccucaacgaugacgggcuggauaaucacacaauucugcuuuacuauucuaccgcggccuccagccucgcuguuacacugaugcuggccaucuucauuguguacauggucucucgcgacaacguguccuguagcaucugccucuga

SEQ ID NO: 210671 - RNA, 1755 nt, Artificial Sequence; identical to SEQ ID NO: 209450
  derived and/or modified sequence opt5 from hemagglutinin__InfluenzaB__AGX23182

SEQ ID NO: 210672 - RNA, 1755 nt, Artificial Sequence; identical to SEQ ID NO: 209450
  derived and/or modified sequence opt5 from hemagglutinin__InfluenzaB__AGX23193

SEQ ID NO: 210673 - RNA, 1755 nt, Artificial Sequence; identical to SEQ ID NO: 210062
  derived and/or modified sequence opt5 from hemagglutinin__InfluenzaB__AGX23204

SEQ ID NO: 210674 - RNA, 1755 nt, Artificial Sequence; identical to SEQ ID NO: 209450
  derived and/or modified sequence opt5 from hemagglutinin__InfluenzaB__AGX23215

SEQ ID NO: 210675 - RNA, 1755 nt, Artificial Sequence
  derived and/or modified sequence opt5 from hemagglutinin__InfluenzaB__AGX23226
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaaggaaggggaggaucagaucacggucuggggauuccauuccgacaauaaaacccagaugaagaaccuguacggcgauagcaauccccaaaaguuuacaucuuccgcuagcgggguuaccacacacuaugugucucagauuggaggcuucccggaccagaccgaggauggcgggcucccucaguccggacggaucguggucgacuacaugauucaaaaacccggcaagacggggacaaucguguaucagcgcggaguucugcuuccucagaaaguguggugcgccagcggcagauccaaggucaucaaagggucucugccccucauuggagaagcggauugucugcaugagaaguacggcggccugaacaaaagcaagcccuacuauaccggggaacacgccaaggcuaucggaaacugcccuauuugggugaaaaccccgcucaagcuggccaauggcacaaaauaccggcccccugcuaagcugcugaaagagcgcggguuuuucggagccaucgccggcuuucucgaagggggcugggaaggaaugauugcuggcuggcacggguauaccucccauggagcgcacggcguugccguggcugccgaccuuaagagcacacaggaggccaucaacaagaucacgaaaaaucuuaacucucuguccgaacucgaggucaagaaucugcaaagacugagcggggcuauggacgaacuccauaacgagauucuggagcuugaugaaaaaguggacgaucugcgggccgacaccaucucuagccagauugagcucgcgguccugcuuuccaaugaaggaaucauuaacucugaggaugaacaucugcucgcucuggagcgcaagcugaaaaagaugcucggccccagcgccguggacaucgggaauggcuguuucgagacaaagcacaaaugcaaccagaccugccuggauagaaucgccgcuggaacauuuaaugccggcgaguucucccuuccuaccuuugacagccugaacauuacggcugccucucucaaugaugacgggcuggauaaccacaccauccugcuuuacuauuccacagcggccagcucucucgcuguuacccugaugcuggccauuuucaucguguacauggucucccgggacaaugugagcuguuccauuugccucuga

SEQ ID NO: 210676 - RNA, 1755 nt, Artificial Sequence; identical to SEQ ID NO: 210623
  derived and/or modified sequence opt5 from hemagglutinin__InfluenzaB__AGX23237

SEQ ID NO: 210677 - RNA, 1755 nt, Artificial Sequence
  derived and/or modified sequence opt5 from hemagglutinin__InfluenzaB__AGX23248
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguaaggaaggggaggaucagaucacggucuggggauuccauuccgacaauaaaacccagaugaagaaccuguacggcgauagcaauccccaaaaguuuacaucuuccgcuagcgggguuaccacacacuaugugucucagauuggaggcuucccggaccagaccgaggauggcgggcucccucaguccggacggaucguggucgacuacaugauucaaaaacccggcaagacggggacaaucguguaucagcgcggaguucugcuuccucagaaaguguggugcgccagcggcagauccaaggucaucaaagggucucugccccucauuggagaagcggauugucugcaugagaaguacggcggccugaacaaaagcaagcccuacuauaccggggaacacgccaaggcuaucggaaacugcccuauuugggugaaaaccccgcucaagcuggccaauggcacaaaauaccggcccccugcuaagcugcugaaagagcgcggguuuuucggagccaucgccggcuuucucgaagggggcugggaaggaaugauugcuggcuggcacggguauaccucccauggagcgcacggcguugccguggcugccgaccuuaagagcacacaggaggccaucaacaagaucacgaaaaaucuuaacucucuguccgaacucgaggucaagaaucugcaaagacugagcggggcuauggacgaacuccauaacgagauucuggagcuugaugaaaaaguggacgaucugcgggccgacaccaucucuagccagauugagcucgcgguccugcuuuccaaugaaggaaucauuaacucugaggaugaacaucugcucgcucuggagcgcaagcugaaaaagaugcucggccccagcgccguggacaucgggaauggcuguuucgagacaaagcacaaaugcaaccagaccugccugaauagaaucgccgcuggaacauuuaacgccggcgaguucucccuuccuaccuuugauagccugaauauuacggcugccucucucaacgacgaugggcuggacaaucacaccauccugcuuuacuauuccacagcggccagcucucucgcuguuacccugaugcuggccauuuucaucguguacauggucucccgggauaacgugagcuguuccauuugccucuga

SEQ ID NO: 210678 - RNA, 1755 nt, Artificial Sequence; identical to SEQ ID NO: 209450
  derived and/or modified sequence opt5 from hemagglutinin__InfluenzaB__AGX23259

SEQ ID NO: 210679 - RNA, 1755 nt, Artificial Sequence; identical to SEQ ID NO: 209450
  derived and/or modified sequence opt5 from hemagglutinin__InfluenzaB__AGX23270

SEQ ID NO: 210680 - RNA, 1755 nt, Artificial Sequence
  derived and/or modified sequence opt5 from hemagglutinin__InfluenzaB__AGX23281
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccgcgagcaaaucuggcuucuuugccacaauggcuugggccgucccuaaggacaauaacaaaaaugcuaccaacccccuuaccguggaggugccuuauauuuguacagaaggggaggaucagaucacggucuggggauuccauuccgacaauaagacccagaugaaaaaccuguacggcgauagcaauccccaaaaguuuacaucuuccgccaacgggguuaccacacacuaugugagccagauuggaggcuucccggaccagaccgaggauggcgggcucccucagucuggacggaucguggucgacuacaugaugcaaaagcccggcaaaacggggacaauuguguaucagcgcggaguucugcuuccucagaagguguggugcgcguccggcagaagcaaagucaucaaggggucccugccccucaucggagaagccgauugucugcaugagaaauacggcggccugaacaagucuaaacccuacuauaccggggaacacgcuaaggccauuggaaauugcccuaucugggugaagaccccgcucaaacuggcuaacggcacaaaguaccggcccccugccaaacuucugaaggagcgcggguuuuucggagccauugcuggcuuucucgaagggggcugggaaggaaugaucgcgggcuggcacggguauaccagccauggagcccacggcguugcuguggccgccgaccugaaauccacacaggaggcuauuaauaagaucacgaagaaccuuaauagccugucugaacucgaggucaaaaaccugcaaagacuguccggggccauggacgaacuccauagcgagauccuggagcuugaugaaaagguggacgaucugcgggcggacaccauuucuagccagaucgagcucgcuguccugcuuuccaaugaaggaauuaucaacucugaggaugaacaucugcucgcccuggagcgcaaacugaagaaaaugcucggccccagcgccguggacauugggaauggcuguuucgagacaaagcacaagugcaaccagaccugccuggauagaaucgcugccggaacauuuaaugcuggcgaguucucccuuccuaccuuugacagccugaacaucacggccgcgucucucaaugaugacgggcuggauaaccacaccauucugcuuuacuauuccacagccgcuagcucucucgccguuacccugaugcuggcuaucuucauuguguacauggucucccgggacaaugugagcuguuccaucugccucuga

SEQ ID NO: 210681 - RNA, 1755 nt, Artificial Sequence
  derived and/or modified sequence opt5 from hemagglutinin__InfluenzaB__AGX23292
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccaauagcaaaucuggcuucuuugcgacaauggccugggcugucccuaaggacaacaauaaaaacgccaccaauccccuuaccguggaggugccuuauauuuguacagaaggggaggaucagaucacggucuggggauuccauuccgacaacaagacccagaugaaaaaucuguacggcgauagcaacccccaaaaguuuacaucuuccgcuaacgggguuaccacacacuaugugagccagauuggaggcuucccggaccagaccgaggauggcgggcucccucagucuggacggaucguggucgacuacaugaugcaaaagcccggcaaaacggggacaauuguguaucagcgcggaguucugcuuccucagaagguguggugcgccuccggcagaagcaaagucaucaaggggucccugccccucaucggagaagcggauugucugcaugagaaauacggcggccugaauaagucuaaacccuacuauaccggggaacacgccaaggcuauuggaaacugcccuaucugggugaagaccccgcucaaacuggccaauggcacaaaguaccggcccccugcuaaacuucugaaggagcgcggguuuuucggagccauugccggcuuucucgaagggggcugggaaggaaugaucgcuggcuggcacggguauaccagccauggagcgcacggcguugccguggcugccgaccugaaauccacacaggaggccauuaacaagaucacgaagaaucuuaacagccugucugaacucgaggucaaaaaucugcaaagacuguccggggcuauggacgaacuccauaacgagauccuggagcuugaugaaaagguggacgaucugcgggccgacaccauuagcucucagaucgagcucgcgguccugcuuagcaaugaaggaauuaucaacuccgaggaugaacaucugcucgcucuggagcgcaaacugaagaaaaugcucggccccucugccguggacauugggaauggcuguuucgagacaaagcacaagugcaaccagaccugccuggauagaaucgccgcuggaacauuuaaugccggcgaguucagccuuccuaccuuugacucccugaacaucacggcugccagccucaaugaugacgggcuggauaaccacaccauucugcuuuacuauucuacagcggccuccagccucgcuguuacccugaugcuggccaucuucauuguguacauggucucucgggacaacguguccuguagcaucugccucuga

SEQ ID NO: 210682 - RNA, 1755 nt, Artificial Sequence
  derived and/or modified sequence opt5 from hemagglutinin__InfluenzaB__AGX23314
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaagagcuccuggcggcccguaccggcuggggaccagcggauccugccccaacgccacaagcaagucuggcuucuuugcgaccauggccugggcugucccuaaagacaauaacaagaaugccaccaacccccuuacaguggaggugccuuauauuuguacggaaggggaggaucagaucaccgucuggggauuccauuccgacaauaaaacacagaugaagaaccuguacggcgauagcaauccccaaaaauuuaccucuuccgcuaacgggguuacaacccacuaugugagccagauuggaggcuucccggaccagacggaggauggcgggcucccucagucuggacgcaucguggucgacuacaugaugcaaaagcccggcaagacagggaccauuguguaucagagaggaguucugcuuccucagaaaguguggugcgccuccggccggagcaaggucaucaaagggucccugccccucaucggagaagcggauugucugcaugagaaguacggcggccugaacaaaucuaagcccuacuauaccggggaacacgccaaagcuauuggaaauugcccuaucugggugaagacaccgcucaagcuggccaacggcaccaaauacagacccccugcuaagcugcugaaagagcgcggguuuuucggagccauugccggcuuucucgaagggggcugggaaggaaugaucgcuggcuggcacggguauacaagccauggagcgcacggcguugccguggcugccgaccugaaguccacgcaggaggccauuaauaaaaucaccaagaaccuuaauagccugucugaacucgaggucaagaaccugcaacggcuguccggggcuauggacgaacuccauaaugagauccuggagcuugaugaaaaaguggacgaucugcgcgccgacacaauuagcucucagaucgagcucgcgguccugcuuagcaacgaaggaauuaucaauuccgaggaugaacaccuucucgcucuggagagaaagcugaaaaagaugcucggccccucugccguggacauugggaacggcuguuucgagaccaaacacaagugcaaucagacaugccuggaucggaucgccgcuggaaccuuuaacgccggcgaguucagccuuccuacguuugacucccugaauaucaccgcugccagccucaacgaugacgggcuggauaaucauacaauucugcuuuacuauucuaccgcggccuccagccucgcuguuacacugaugcuggccaucuucauuguguacauggucucuagagacaacguguccuguagcaucugccucuga

SEQ ID NO: 210683 - RNA, 1755 nt, Artificial Sequence; identical to SEQ ID NO: 210682
  derived and/or modified sequence opt5 from hemagglutinin__InfluenzaB__AGX23325

SEQ ID NO: 210684 - RNA, 1755 nt, Artificial Sequence; identical to SEQ ID NO: 210682
  derived and/or modified sequence opt5 from hemagglutinin__InfluenzaB__AGX23336

SEQ ID NO: 210685 - RNA, 1755 nt, Artificial Sequence; identical to SEQ ID NO: 210682
  derived and/or modified sequence opt5 from hemagglutinin__InfluenzaB__AGX23347

SEQ ID NO: 210686 - RNA, 1755 nt, Artificial Sequence; identical to SEQ ID NO: 210682
  derived and/or modified sequence opt5 from hemagglutinin__InfluenzaB__AGX23358

SEQ ID NO: 210687 - RNA, 1755 nt, Artificial Sequence; identical to SEQ ID NO: 210682
  derived and/or modified sequence opt5 from hemagglutinin__InfluenzaB__AGX23369

SEQ ID NO: 210688 - RNA, 1755 nt, Artificial Sequence; identical to SEQ ID NO: 210682
  derived and/or modified sequence opt5 from hemagglutinin__InfluenzaB__AGX23380

SEQ ID NO: 210689 - RNA, 1755 nt, Artificial Sequence; identical to SEQ ID NO: 209450
  derived and/or modified sequence opt5 from hemagglutinin__InfluenzaB__AGX23391

SEQ ID NO: 210690 - RNA, 1755 nt, Artificial Sequence
  derived and/or modified sequence opt5 from hemagglutinin__InfluenzaB__AGX23413
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuaaucagaacgugaucgaugccgaaagagcuccuggcggcccguaccggcuggggacaagcggauccugccccaaugccaccagcaagucuggcuucuuugcgacaauggccugggcugucccuaaagacaacaauaagaacgccaccaauccccuuaccguggaggugccuuauauuuguacagaaggggaggaucagaucacggucuggggauuccauuccgacaacaaaacccagaugaagaaucuguacggcgauagcaacccccaaaaauuuacaucuuccgcuaacgggguuaccacacacuaugugagccagauuggaggcuucccggaccagaccgaggauggcgggcucccucagucuggacgcaucguggucgacuacaugaugcaaaagcccggcaagacggggacaauuguguaucagagaggaguucugcuuccucagaaaguguggugcgccuccggccggagcaaggucaucaaagggucccugccccucaucggagaagcggauugucugcaugagaaguacggcggccugaauaaaucuaagcccuacuauaccggggaacacgccaaagcuauuggaaacugcccuaucugggugaagaccccgcucaagcuggccaauggcacaaaauacagacccccugcuaagcugcugaaagagcgcggguuuuucggagccauugccggcuuucucgaagggggcugggaaggaaugaucgcuggcuggcacggguauaccagccauggagcgcacggcguugccguggcugccgaccugaaguccacacaggaggccauuaacaaaaucacgaagaaucuuaacagccugucugaacucgaggucaagaaucugcaacggcuguccggggcuauggacgaacuccauaacgagauccuggagcuugaugaaaaaguggacgaucugcgcgccgacaccauuagcucucagaucgagcucgcgguccugcuuagcaaugaaggaauuaucaacuccgaggaugaacaccuucucgcucuggagagaaagcugaaaaagaugcucggccccucugccguggacauugggaauggcuguuucgagacaaaacacaagugcaaccagaccugccuggaucggaucgccgcuggaacauuuaaugccggcgaguucagccuuccuaccuuugacucccugaacaucacggcugccagccucaaugaugacgggcuggauaaccauaccauucugcuuuacuauucuacagcggccuccagccucgcuguuacccugaugcuggccaucuucauuguguacauggucucuagagacaacguguccuguagcaucugccucuga

SEQ ID NO: 210691 - RNA, 1755 nt, Artificial Sequence; identical to SEQ ID NO: 210690
  derived and/or modified sequence opt5 from hemagglutinin__InfluenzaB__AGX23424

SEQ ID NO: 210692 - RNA, 1755 nt, Artificial Sequence; identical to SEQ ID NO: 209844
  derived and/or modified sequence opt5 from hemagglutinin__InfluenzaB__AGX23435

SEQ ID NO: 210693 - RNA, 1755 nt, Artificial Sequence; identical to SEQ ID NO: 209755
  derived and/or modified sequence opt5 from hemagglutinin__InfluenzaB__AGX23446

SEQ ID NO: 210694 - RNA, 1755 nt, Artificial Sequence; identical to SEQ ID NO: 209844
  derived and/or modified sequence opt5 from hemagglutinin__InfluenzaB__AGX23457

SEQ ID NO: 210695 - RNA, 1755 nt, Artificial Sequence; identical to SEQ ID NO: 209755
  derived and/or modified sequence opt5 from hemagglutinin__InfluenzaB__AGX23468

SEQ ID NO: 210696 - RNA, 1755 nt, Artificial Sequence; identical to SEQ ID NO: 209450
  derived and/or modified sequence opt5 from hemagglutinin__InfluenzaB__AGX23479

SEQ ID NO: 210697 - RNA, 1755 nt, Artificial Sequence; identical to SEQ ID NO: 209450
  derived and/or modified sequence opt5 from hemagglutinin__InfluenzaB__AGX23490

SEQ ID NO: 210698 - RNA, 1755 nt, Artificial Sequence; identical to SEQ ID NO: 210071
  derived and/or modified sequence opt5 from hemagglutinin__InfluenzaB__AGX23501

SEQ ID NO: 210699 - RNA, 1755 nt, Artificial Sequence
  derived and/or modified sequence opt5 from hemagglutinin__InfluenzaB__AGX23512
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuuguacggaaggggaggaucagaucaccgucuggggauuccauuccgacaauaaaacacagaugaagacccuguacggcgauagcaacccccaaaaguuuacaucuuccgcuaaugggguuaccacgcacuaugugagccagauuggaggcuucccggaccagacagaggauggcgggcucccucagucuggaagaaucguggucgacuacaugaugcaaaaacccggcaagaccgggaccauuguguaucagcggggaguucugcuuccucagaaaguguggugcgccuccggccgcagcaaggucaucaaagggucccugccccucaucggagaagcggauugucugcaugagaaguacggcggccugaacaaaucuaagcccuacuauacaggggaacacgccaaggcuauuggaaacugcccuaucugggugaaaaccccgcucaagcuggccaauggcacaaaauacagacccccugcuaaacuucugaaagagcggggguuuuucggagccauugccggcuuucucgaagggggcugggaaggaaugaucgcuggcuggcacggguauacgagccauggagcgcacggcguugccguggcugccgaccugaaguccacccaggaggccauuaacaagaucacaaagaaucuuaacagccugucugaacucgaggucaagaaucugcaacgccuguccggggcuauggacgaacuccauaacgagauccuggagcuugaugaaaaaguggacgaucugagagccgacaccauuagcucucagaucgagcucgcgguccugcuuagcaaugaaggaauuaucaacuccgaggaugaacaucugcucgcucuggagcggaagcugaaaaagaugcucggccccucugccguggacauugggaauggcuguuucgagacaaagcacaaaugcaaccagaccugccuggaucgcaucgccgcuggaacguuuaaugccggcgaguucagccuuccuaccuuugacucccugaacaucacagcugccagccucaaugaugacgggcuggauaaccacaccauucugcuuuacuauucuacagcggccuccagccucgcuguuacccugaugcuggccaucuucauuguguacauggucucuagagacaauguguccuguagcaucugccucuga

SEQ ID NO: 210700 - RNA, 1755 nt, Artificial Sequence; identical to SEQ ID NO: 209450
  derived and/or modified sequence opt5 from hemagglutinin__InfluenzaB__AGX23523

SEQ ID NO: 210701 - RNA, 1755 nt, Artificial Sequence; identical to SEQ ID NO: 209755
  derived and/or modified sequence opt5 from hemagglutinin__InfluenzaB__AGX23534

SEQ ID NO: 210702 - RNA, 1755 nt, Artificial Sequence; identical to SEQ ID NO: 209755
  derived and/or modified sequence opt5 from hemagglutinin__InfluenzaB__AGX23545

SEQ ID NO: 210703 - RNA, 1755 nt, Artificial Sequence; identical to SEQ ID NO: 209450
  derived and/or modified sequence opt5 from hemagglutinin__InfluenzaB__AGX23556

SEQ ID NO: 210704 - RNA, 1755 nt, Artificial Sequence; identical to SEQ ID NO: 209450
  derived and/or modified sequence opt5 from hemagglutinin__InfluenzaB__AGX23567

SEQ ID NO: 210705 - RNA, 1755 nt, Artificial Sequence; identical to SEQ ID NO: 209450
  derived and/or modified sequence opt5 from hemagglutinin__InfluenzaB__AGX23578

SEQ ID NO: 210706 - RNA, 1755 nt, Artificial Sequence; identical to SEQ ID NO: 209450
  derived and/or modified sequence opt5 from hemagglutinin__InfluenzaB__AGX23600

SEQ ID NO: 210707 - RNA, 1755 nt, Artificial Sequence
  derived and/or modified sequence opt5 from hemagglutinin__InfluenzaB__AGX23611
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucuaaacccuacuauaccggggaacacgccaaggcuauuggaaauugcccuaucugggugaagacaccgcucaaacuggccaacggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaauccacgcaggaggccauuaauaagaucaccaagaaccuuaauagccugucugaacucgagaucaaaaaccugcaaagacuguccggggcuauggacgaacuccauaaugagauucuggagcuugaugaaaaggucgacgaucugcgggccgacacaaucagcucucagauugagcucgcggugcugcuuagcaacgaaggaaucauuaauuccgaggaugaacaucugcucgcucuggagcgcaaacugaagaaaaugcucggccccucugccgucgacaucgggaacggcuguuucgagaccaagcacaagugcaaucagacaugccuggauagaaucgccgcuggaaccuuuaacgccggcgaguucagccuuccuacguuugacucccugaauauuaccgcugccagccucaacgaugacgggcuggauaaucacacaauccugcuuuacuauucuaccgcggccuccagccucgcugugacacugaugcuggccauuuucaucguuuacauggugucucgggacaacgucuccuguagcauuugccucuga

SEQ ID NO: 210708 - RNA, 1755 nt, Artificial Sequence; identical to SEQ ID NO: 209450
  derived and/or modified sequence opt5 from hemagglutinin__InfluenzaB__AGX23622

SEQ ID NO: 210709 - RNA, 1755 nt, Artificial Sequence; identical to SEQ ID NO: 209755
  derived and/or modified sequence opt5 from hemagglutinin__InfluenzaB__AGX23633

SEQ ID NO: 210710 - RNA, 1755 nt, Artificial Sequence; identical to SEQ ID NO: 209755
  derived and/or modified sequence opt5 from hemagglutinin__InfluenzaB__AGX23644

SEQ ID NO: 210711 - RNA, 1755 nt, Artificial Sequence; identical to SEQ ID NO: 209450
  derived and/or modified sequence opt5 from hemagglutinin__InfluenzaB__AGX23655

SEQ ID NO: 210712 - RNA, 1755 nt, Artificial Sequence; identical to SEQ ID NO: 209755
  derived and/or modified sequence opt5 from hemagglutinin__InfluenzaB__AGX23666

SEQ ID NO: 210713 - RNA, 1755 nt, Artificial Sequence
  derived and/or modified sequence opt5 from hemagglutinin__InfluenzaB__AGX23677
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaaaauucggcucucuacacagaacgugaucgaugccgaaaaggcuccuggcggcccguaccgccuggggaccagcggauccugccccaaugccacaagcaaaucuggcuucuuugcgaccauggccugggcugucccuaaggacaacaauaaaaacgccaccaauccccuuacaguggaggugccuuauauuuguaucgaaggggaggaucagauuacggucuggggauuccauuccgacaacaagacccagaugaagaaucuguacggcgauagcaacccccaaaaauuuacaucuuccgcuaaugggguuaccacacacuaugugagccagaucggaggcuucccggaccagaccgaggauggcgggcucccucagucuggaagaauuguggucgacuacaugaugcaaaagcccggcaaaacggggacaaucguguaucagcggggaguucugcuuccucagaagguguggugcgccuccggccgcagcaaagucaucaaggggucccugccccucauuggagaagcggauugucugcaugagaaauacggcggccugaacaagucuaagcccuacuauaccggggaacacgccaaagcuaucggaaacugcccuauuugggugaagaccccgcucaaacuggccaauggcacaaaguacagacccccugcuaaacuucugaaggagcggggguuuuucggagccaucgccggcuuucucgaagggggcugggaaggaaugauugcuggcuggcacggguauaccagccauggagcgcacggcguugccguggcugccgaccugaaguccacacaggaggccaucaacaaaaucacgaagaaucuuaacagccugucugaacucgaggucaaaaaucugcaacgccuguccggggcuauggacgaacuccauaacgagauucuggagcuugaugaaaagguggacgaucugagagccgacaccaucagcucucagauugagcucgcgguccugcuuagcaaugaaggaaucauuaacuccgaggaugaacaucugcucgcucuggagcggaaacugaagaagaugcucggccccucugccguggacaucgggaauggcuguuucgagacaaaacacaagugcaaccagaccugccuggaucgcaucgccgcuggaacauuuaaugccggcgaguucagccuuccuaccuuugacucccugaacauuacggcugccagccucaaugaugacgggcuggauaaccacaccauccugcuuuacuauucuacagcggccuccagccucgcuguuacccugaugcuggccauuuucaucguguacauggucucuagagacaauguguccuguagcauuugccucuga

SEQ ID NO: 210714 - RNA, 1755 nt, Artificial Sequence; identical to SEQ ID NO: 209755
  derived and/or modified sequence opt5 from hemagglutinin__InfluenzaB__AGX23688

SEQ ID NO: 210715 - RNA, 1755 nt, Artificial Sequence; identical to SEQ ID NO: 209755
  derived and/or modified sequence opt5 from hemagglutinin__InfluenzaB__AGX23699

SEQ ID NO: 210716 - RNA, 1755 nt, Artificial Sequence; identical to SEQ ID NO: 209450
  derived and/or modified sequence opt5 from hemagglutinin__InfluenzaB__AGX23710

SEQ ID NO: 210717 - RNA, 1755 nt, Artificial Sequence; identical to SEQ ID NO: 209755
  derived and/or modified sequence opt5 from hemagglutinin__InfluenzaB__AGX23721

SEQ ID NO: 210718 - RNA, 1755 nt, Artificial Sequence; identical to SEQ ID NO: 209450
  derived and/or modified sequence opt5 from hemagglutinin__InfluenzaB__AGX23732

SEQ ID NO: 210719 - RNA, 1755 nt, Artificial Sequence; identical to SEQ ID NO: 209755
  derived and/or modified sequence opt5 from hemagglutinin__InfluenzaB__AGX23743

SEQ ID NO: 210720 - RNA, 1755 nt, Artificial Sequence; identical to SEQ ID NO: 209755
  derived and/or modified sequence opt5 from hemagglutinin__InfluenzaB__AGX23754

SEQ ID NO: 210721 - RNA, 1755 nt, Artificial Sequence; identical to SEQ ID NO: 209450
  derived and/or modified sequence opt5 from hemagglutinin__InfluenzaB__AGX23765

SEQ ID NO: 210722 - RNA, 1755 nt, Artificial Sequence; identical to SEQ ID NO: 209755
  derived and/or modified sequence opt5 from hemagglutinin__InfluenzaB__AGX23776

SEQ ID NO: 210723 - RNA, 1755 nt, Artificial Sequence; identical to SEQ ID NO: 209755
  derived and/or modified sequence opt5 from hemagglutinin__InfluenzaB__AGX23787

SEQ ID NO: 210724 - RNA, 1755 nt, Artificial Sequence; identical to SEQ ID NO: 209450
  derived and/or modified sequence opt5 from hemagglutinin__InfluenzaB__AGX23798

SEQ ID NO: 210725 - RNA, 1755 nt, Artificial Sequence; identical to SEQ ID NO: 209450
  derived and/or modified sequence opt5 from hemagglutinin__InfluenzaB__AGX23809

SEQ ID NO: 210726 - RNA, 1755 nt, Artificial Sequence; identical to SEQ ID NO: 209450
  derived and/or modified sequence opt5 from hemagglutinin__InfluenzaB__AGX23820

SEQ ID NO: 210727 - RNA, 1755 nt, Artificial Sequence; identical to SEQ ID NO: 209755
  derived and/or modified sequence opt5 from hemagglutinin__InfluenzaB__AGX23831

SEQ ID NO: 210728 - RNA, 1755 nt, Artificial Sequence; identical to SEQ ID NO: 209450
  derived and/or modified sequence opt5 from hemagglutinin__InfluenzaB__AGX23842

SEQ ID NO: 210729 - RNA, 1755 nt, Artificial Sequence
  derived and/or modified sequence opt5 from hemagglutinin__InfluenzaB__AGX23853
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuauccagaaugugauugaugccgaaaaggcuccuggcggcccguacagacuggggacaagcggauccugccccaacgccaccagcaaaucuggcuucuuugcgacaauggccugggcugucccuaaggacaauaacaaaaaugccaccaacccccuuaccguggaggugccuuauaucuguacagaaggggaggaucagauuacggucuggggauuccauuccgacaauaagacccagaugaaaaaccuguacggcgauagcaauccccaaaaguuuacaucuuccgcuaacgggguuaccacacacuaugugagccagaucggaggcuucccggaccagaccgaggauggcgggcucccucagucuggacggauuguggucgacuacaugaugcaaaaguccggcaaaacggggacaaucguguaucagcgcggaguucugcuuccccagaagguguggugcgccagcggcagauccaaagucaucaaggggucucugccucucauuggagaagcggauugucugcaugagaaauacggcggccugaacaagagcaaacccuacuauaccggggaacacgccaaggcuaucggaaauugccccauuugggugaagaccccucucaaacuggccaacggcacaaaguaccggccgcccgcuaaacuucugaaggagcgcggguuuuucggagccaucgccggcuuucucgaagggggcugggaaggaaugauugcuggcuggcacggguauaccucccauggagcgcacggcguugccguggcugccgaccugaaaagcacacaggaggccaucaauaagaucacgaagaaccuuaauucucuguccgaacucgaggucaaaaaccugcaaagacugagcggggcuauggacgaacuccauaaugagauucuggagcuugaugaaaagguggacgaucugcgggccgacaccaucucuagccagauugagcucgcgguccugcuuuccaacgaaggaaucauuaauucugaggaugaacaucugcucgcucuggagcgcaaacugaagaaaaugcucggcccuagcgccguggacaucgggaacggcuguuucgagacaaagcacaagugcaaucagaccugccuggauagaaucgccgcuggaacauuuaacgccggcgaguucucccuucccaccuuugacagccugaauauuacggcugccucucucaacgaugacgggcuggauaaucacaccauccugcuuuacuauuccacagcggccagcucucucgcuguuacccugaugcuggccauuuucaucguguacauggucucccgggacaacgugagcuguuccauuugccucuga

SEQ ID NO: 210730 - RNA, 1755 nt, Artificial Sequence; identical to SEQ ID NO: 209450
  derived and/or modified sequence opt5 from hemagglutinin__InfluenzaB__AGX23864

SEQ ID NO: 210731 - RNA, 1755 nt, Artificial Sequence; identical to SEQ ID NO: 209755
  derived and/or modified sequence opt5 from hemagglutinin__InfluenzaB__AGX23875

SEQ ID NO: 210732 - RNA, 1755 nt, Artificial Sequence; identical to SEQ ID NO: 209450
  derived and/or modified sequence opt5 from hemagglutinin__InfluenzaB__AGX23886

SEQ ID NO: 210733 - RNA, 1755 nt, Artificial Sequence
  derived and/or modified sequence opt5 from hemagglutinin__InfluenzaB__AGX23897
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaaguccggcaaaacagggaccauuguguaucagcgcggaguucugcuuccccagaagguguggugcgccagcggcagauccaaagucaucaaggggucucugccucucaucggagaagcggauugucugcaugagaaauacggcggccugaacaagagcaaacccuacuauaccggggaacacgccaaggcuauuggaaauugccccaucugggugaagacaccucucaaacuggccaacggcaccaaguaccggccgcccgcuaaacuucugaaggagcgcggguuuuucggagccauugccggcuuucucgaagggggcugggaaggaaugaucgcuggcuggcacggguauacaucccauggagcgcacggcguugccguggcugccgaccugaaaagcacgcaggaggccauuaauaagaucaccaagaaccuuaauucucuguccgaacucgaggucaaaaaccugcaaagacugagcggggcuauggacgaacuccauaaugagauccuggagcuugaugaaaagguggacgaucugcgggccgacacaauuucuagccagaucgagcucgcgguccugcuuuccaacgaaggaauuaucaauucugaggaugaacaucugcucgcucuggagcgcaaacugaagaaaaugcucggcccuagcgccguggacauugggaacggcuguuucgagaccaagcacaagugcaaucagacaugccuggauagaaucgccgcuggaaccuuuaacgccggcgaguucucccuucccacguuugacagccugaauaucaccgcugccucucucaacgaugacgggcuggauaaucacacaauucugcuuuacuauuccaccgcggccagcucucucgcuguuacacugaugcuggccaucuucauuguguacauggucucccgggacaacgugagcuguuccaucugccucuga

SEQ ID NO: 210734 - RNA, 1755 nt, Artificial Sequence
  derived and/or modified sequence opt5 from hemagglutinin__InfluenzaB__AGX23908
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugucaccauggcgugggccgugccuaaggacaauaacaaaaaugcuaccaacccccuuacaguggaggucccuuauauuuguacggaaggggaggaucagaucaccguuuggggauuccauuccgacaauaagacacagaugaaaaaccuguacggcgauagcaauccccaaaaguuuaccucuuccgccaacggggugacaacccacuaugugagccagauuggaggcuucccggaccagacggaggauggcgggcucccucagucuggacggaucgucguggacuacaugaugcaaaagcccggcaaaacagggaccauuguuuaucagcgcggagugcugcuuccucagaaggucuggugcgcuuccggcagaagcaaagugaucaaggggucccugccccucaucggagaagccgauugucugcaugagaaauacggcggccugaacaagucuaaacccuacuauaccggggaacacgcgaaggccauuggaaauugcccuaucuggguuaagacaccgcucaaacuggcuaacggcaccaaguaccggcccccugccaaacuucugaaggagcgcggguuuuucggagcuauugccggcuuucucgaagggggcugggaaggaaugaucgccggcuggcacggguauacaagccauggagcucacggcguggcggucgccgcugaccugaaauccacgcaggaggccauuaauaagaucaccaagaaccuuaauagccugucugaacucgaggugaaaaaccugcaaagacuguccggggccauggacgaacuccauaaugagauccuggagcuugaugaaaaggucgacgaucugcgggcugacacaauuagcucucagaucgagcucgccgugcugcuuagcaacgaaggaauuaucaauuccgaggaugaacaucugcucgcgcuggagcgcaaacugaagaaaaugcucggccccucugcuguugacauugggaacggcuguuucgagaccaagcacaagugcaaucagacaugccuggauagaaucgccgccggaaccuuuaacgcuggcgaguucagccuuccuacguuugacucccugaauaucaccgccgcuagccucaacgaugacgggcuggauaaucacacaauucugcuuuacuauucuaccgccgcguccagccucgccgugacacugaugcuggcuaucuucauugucuacauggugucucgggacaacguuuccuguagcaucugccucuga

SEQ ID NO: 210735 - RNA, 1755 nt, Artificial Sequence; identical to SEQ ID NO: 209591
  derived and/or modified sequence opt5 from hemagglutinin__InfluenzaB__AGX23919

SEQ ID NO: 210736 - RNA, 1755 nt, Artificial Sequence; identical to SEQ ID NO: 210071
  derived and/or modified sequence opt5 from hemagglutinin__InfluenzaB__AGX23930

SEQ ID NO: 210737 - RNA, 1755 nt, Artificial Sequence; identical to SEQ ID NO: 209450
  derived and/or modified sequence opt5 from hemagglutinin__InfluenzaB__AGX23941

SEQ ID NO: 210738 - RNA, 1755 nt, Artificial Sequence; identical to SEQ ID NO: 209755
  derived and/or modified sequence opt5 from hemagglutinin__InfluenzaB__AGX23952

SEQ ID NO: 210739 - RNA, 1755 nt, Artificial Sequence; identical to SEQ ID NO: 209755
  derived and/or modified sequence opt5 from hemagglutinin__InfluenzaB__AGX23963

SEQ ID NO: 210740 - RNA, 1755 nt, Artificial Sequence; identical to SEQ ID NO: 210071
  derived and/or modified sequence opt5 from hemagglutinin__InfluenzaB__AGX23974

SEQ ID NO: 210741 - RNA, 1755 nt, Artificial Sequence; identical to SEQ ID NO: 209591
  derived and/or modified sequence opt5 from hemagglutinin__InfluenzaB__AGX23985

SEQ ID NO: 210742 - RNA, 1755 nt, Artificial Sequence
  derived and/or modified sequence opt5 from hemagglutinin__InfluenzaB__AGX23996
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuaucaccuccggguguuuucccaucaugcacgaccgcacgaagauuagacaacucgcuaaucugcugcggggauaugagaacauccgccucucuacacagaauguuauugaugccgaaaaggcuccuggcggcccguacagacuggggaccagcggauccugccccaacgccacaagcaaaucuggcuucuuugcgaccauggccugggcugugccuaaggacaauaacaaaaaugccaccaacccccuuacagucgaggugccuuauaucuguacggaaggggaggaucagauuaccguguggggauuccauuccgacaauaagacacagaugaaaaaccuguacggcgauagcaauccccaaaaguuuaccucuuccgcuaacggggucacaacccacuauguuagccagaucggaggcuucccggaccagacggaggauggcgggcucccucagucuggacggauugugguggacuacaugaugcaaaagcccggcaaaacagggaccaucgucuaucagcgcggagugcugcuuccucagaagguuuggugcgccuccggcagaagcaaagugaucaaggggucccugccccucauuggagaagcggauugucugcaugagaaauacggcggccugaacaagucuaaacccuacuauaccggggaacacgccaaggcuaucggaaauugcccuauuugggucaagacaccgcucaaacuggccaacggcaccaaguaccggcccccugcuaaacuucugaaggagcgcggguuuuucggagccaucgccggcuuucucgaagggggcugggaaggaaugauugcuggcuggcacggguauacaagccauggagcgcacggcguggccguugcugccgaccugaaauccacgcaggaggccaucaauaagaucaccaagaaccuuaauagccugucugaacucgaggugaaaaaccugcaaagacuguccggggcuauggacgaacuccauaaugagauucuggagcuugaugaaaaggucgacgaucugcgggccgacacaaucagcucucagauugagcucgcggugcugcuuagcaacgaaggaaucauuaauuccgaggaugaacaucugcucgcucuggagcgcaaacugaagaaaaugcucggccccucugccgucgacaucgggaacggcuguuucgagaccaagcacaagugcaaucagacaugccuggauagaaucgccgcuggaaccuuuaacgccggcgaguucagccuuccuacguuugacucccugaauauuaccgcugccagccucaacgaugacgggcuggauaaucacacaauccugcuuuacuauucuaccgcggccuccagccucgcugugacacugaugcuggccauuuucaucguuuacauggugucucgggacaacgucuccuguagcauuugccucuga

SEQ ID NO: 210743 - RNA, 1755 nt, Artificial Sequence; identical to SEQ ID NO: 210071
  derived and/or modified sequence opt5 from hemagglutinin__InfluenzaB__AGX24007

SEQ ID NO: 210744 - RNA, 1755 nt, Artificial Sequence; identical to SEQ ID NO: 210071
  derived and/or modified sequence opt5 from hemagglutinin__InfluenzaB__AGX24018

SEQ ID NO: 210745 - RNA, 1755 nt, Artificial Sequence
  derived and/or modified sequence opt5 from hemagglutinin__InfluenzaB__AGX24029
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguaaggaaggggaggaucagaucacggucuggggauuccauuccgacaauaaaacccagaugaagaaccuguacggcgauagcaauccgcaaaaguuuacaucuuccgccaacgggguuaccacacacuaugugagccagauuggaucuuucccugaccagaccgaggauggcggccucccccaguccgggcggaucguggucgacuacaugaugcaaaaaccuggaaagacgggcacaauuguguaucagcgcgggguucugcuuccccagaaaguguggugcgcuagcggaagauccaaggucaucaaaggcucucugccccucaucggggaagccgauugucugcaugagaaguacggaggccugaacaaaagcaagccuuacuauaccggcgaacacgcgaaggccauugggaauugcccgaucugggugaaaacaccccucaagcuggcuaacggaaccaaauaccggccucccgccaagcugcugaaagagcgcggcuuuuucggggcuauugccggauuucucgagggcgggugggaaggcaugaucgccggauggcacggcuauaccucccauggggcucacggaguugcgguggccgcugaccuuaagagcacacaggaggccauuaauaagaucacgaaaaaccuuaauucucuguccgaacucgaggucaagaaccugcaaagacugagcggcgccauggacgaacuccauaaugagauccuggagcuugaugaaaaaguggacgaucugcgggcugacaccauuucuagccagaucgagcucgccguccugcuuuccaacgaagggauuaucaauucugaggaugaacaucugcucgcgcuggagcgcaagcugaaaaagaugcucggaccuagcgcuguggagauuggcaacggguguuucgaaacaaagcacaaaugcaaucagaccugccugaacagaaucgccgccggcacauuuaaugcuggagaguucucccuucccaccuuugacagccugaacaucacggccgcuucucucaaugaugacggccuggauaaccacaccauucugcuuuacuauuccacagccgcgagcucucucgccguuacccugaugcuggcuaucuucauuguguacauggucucccgggacaacgugagcuguuccaucugccucuga

SEQ ID NO: 210746 - RNA, 1755 nt, Artificial Sequence; identical to SEQ ID NO: 210071
  derived and/or modified sequence opt5 from hemagglutinin__InfluenzaB__AGX24040

SEQ ID NO: 210747 - RNA, 1755 nt, Artificial Sequence; identical to SEQ ID NO: 209755
  derived and/or modified sequence opt5 from hemagglutinin__InfluenzaB__AGX24051

SEQ ID NO: 210748 - RNA, 1755 nt, Artificial Sequence; identical to SEQ ID NO: 209844
  derived and/or modified sequence opt5 from hemagglutinin__InfluenzaB__AGX24062

SEQ ID NO: 210749 - RNA, 1755 nt, Artificial Sequence; identical to SEQ ID NO: 209591
  derived and/or modified sequence opt5 from hemagglutinin__InfluenzaB__AGX24073

SEQ ID NO: 210750 - RNA, 1755 nt, Artificial Sequence
  derived and/or modified sequence opt5 from hemagglutinin__InfluenzaB__AGX24084
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauuauccaugaagugcggccuguuaccuccggguguuuucccaucaugcacgaccgcacgaagauuagacaacuggcuaaucuccugcggggauaugagaacauccgccugucuacacagaaugugauugaugccgaaaaggcuccuggcggcccguacagacucgggaccagcggauccugccccaacgccacaagcaaaucuggcuucuuugcgaccauggccugggcugucccuaaggacaauaacaaaaaugccaccaacccccugacaguggaggugccuuauaucuguacggaaggggaggaucagauuaccgucuggggauuccauuccgacaauaagacacagaugaaaaaccuuuacggcgauagcaauccccaaaaguuuaccucuuccgcuaacgggguuacaacccacuaugugagccagaucggaggcuucccggaccagacggaggauggcgggcugccucagucuggacggauuguggucgacuacaugaugcaaaagcccggcaaaacagggaccaucguguaucagcgcggaguucuccugccucagaagguguggugcgccuccggcagaagcaaagucaucaaggggucccuuccccugauuggagaagcggauugucuccaugagaaauacggcggccugaacaagucuaaacccuacuauaccggggaacacgccaaggcuaucggaaauugcccuauuugggugaagacaccgcugaaacucgccaacggcaccaaguaccggcccccugcuaaacugcuuaaggagcgcggguuuuucggagccaucgccggcuuucuggaagggggcugggaaggaaugauugcuggcuggcacggguauacaagccauggagcgcacggcguugccguggcugccgaccucaaauccacgcaggaggccaucaauaagaucaccaagaaccugaauagccuuucugaacuggaggucaaaaaccuccaaagacuguccggggcuauggacgaacugcauaaugagauucucgagcuggaugaaaagguggacgaucuucgggccgacacaaucagcucucagauugagcuggcgguccuccugagcaacgaaggaaucauuaauuccgaggaugaacaccuucuggcucucgagcgcaaacugaagaaaaugcugggccccucugccguggacaucgggaacggcuguuucgagaccaagcacaagugcaaucagacaugccucgauagaaucgccgcuggaaccuuuaacgccggcgaguucagccugccuacguuugacucccuuaauauuaccgcugccagccugaacgaugacgggcucgauaaucauacaauccugcuguacuauucuaccgcggccuccagccuugcuguuacacucaugcuggccauuuucaucguguacauggucucucgggacaacguguccuguagcauuugccuguga

SEQ ID NO: 210751 - RNA, 1755 nt, Artificial Sequence; identical to SEQ ID NO: 210071
  derived and/or modified sequence opt5 from hemagglutinin__InfluenzaB__AGX24095

SEQ ID NO: 210752 - RNA, 1755 nt, Artificial Sequence
  derived and/or modified sequence opt5 from hemagglutinin__InfluenzaB__AGX24106
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacacaaccagcaaaucuggcuucuuugccaccauggcgugggccgucccuaaggacaauaacaaaaaugcuacaaacccccuuacgguggaggugccuuauauuuguaccgaaggggaggaucagaucacagucuggggauuccauuccgacaauaagacccagaugaaaaaccuguacggcgauagcaauccccaaaaguuuacaucuuccgccaacgggguuaccacgcacuaugugagccagauuggaggcuucccggaccagacagaggauggcgggcucccucagucuggacggaucguggucgacuacaugaugcaaaagcccggcaaaaccgggaccauuguguaucagcgcggaguucugcuuccucagaagguguggugcgcuuccggcagaagcaaagucaucaaggggucccugccccucaucggagaagccgauugucugcaugagaaauacggcggccugaacaagucuaaacccuacuauacaggggaacacgcgaaggccauuggaaauugcccuaucugggugaagaccccgcucaaacuggcuaacggcacaaaguaccggcccccugccaaacuucugaaggagcgcggguuuuucggagcuauugccggcuuucucgaagggggcugggaaggaaugaucgccggcuggcacggguauacgagccauggagcucacggcguugcgguggccgcugaccugaaauccacccaggaggccauuaauaagaucacaaagaaccuuaauagccugucugaacucgaggucaaaaaccugcaaagacuguccggggccauggacgaacuccauaaugagauccuggagcuugaugaaaagguggacgaucugcgggcugacaccauuagcucucagaucgagcucgccguccugcuuagcaacgaaggaauuaucaauuccgaggaugaacaucugcucgcgcuggagcgcaaacugaagaaaaugcucggccccucugcuguggacauugggaacggcuguuucgagacaaagcacaagugcaaucagaccugccuggauagaaucgccgccggaacguuuaacgcuggcgaguucagccuuccuaccuuugacucccugaauaucacagccgcuagccucaacgaugacgggcuggauaaucacaccauucugcuuuacuauucuacagccgcguccagccucgccguuacccugaugcuggcuaucuucauuguguacauggucucucgggacaacguguccuguagcaucugccucuga

SEQ ID NO: 210753 - RNA, 1755 nt, Artificial Sequence
  derived and/or modified sequence opt5 from hemagglutinin__InfluenzaB__AGX24117
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacacaaccagcaaaucuggcuucuuugcuaccauggccugggcgguccccaaggacaauaacaaaaaugccacaaacccucuuacgguggaggugcccuauauuuguaccgaaggggaggaucagaucacagucuggggauuccauuccgacaauaagacccagaugaaaaaccuguacggcgauagcaauccgcaaaaguuuacaucuuccgcuaacgggguuaccacgcacuaugugagccagauuggaucuuucccugaccagacagaggauggcggccucccccaguccgggcggaucguggucgacuacaugaugcaaaagccuggaaaaaccggcaccauuguguaucagcgcgggauccugcuuccccagaagguuuggugcgccagcggaagauccaaagugaucaagggcucucugccccucauuggggaagcugauugucugcaugagaaauacggaggccugaacaagagcaaaccuuacuauacaggcgaacacgccaaggcgaucgggaauugcccgauuugggucaagacaccccucaaacuggccaacggaaccaaguaccggccucccgcuaaacuucugaaggagcgcggcuuuuucggggccaucgcuggauuucucgagggcgggugggaaggcaugauugccggauggcacggcuauacgucccauggggcccacggaguggcuguugcggccgaccugaaaagcacccaggaggcuaucaauaagaucacaaagaaccuuaauucucuguccgaacucgaggugaaaaaccugcaaagacugagcggcgccauggacgaacuccauaaugagauucuggagcuugaugaaaaggucgacgaucugcgggccgacaccaucucuagccagauugagcucgcugugcugcuuuccaacgaagggaucauuaauucugaggaugaacaucugcucgcccuggagcgcaaacugaagaaaaugcucggaccuagcgcggucgagaucggcaacggguguuucgaaacaaagcacaagugcaaucagaccugccuggacagaaucgcugccggcacguuuaacgccggagaguucucccuucccaccuuugauagccugaauauuacagcugccucucucaacgacgauggccuggacaaucacaccauccugcuuuacuauuccacagcugccagcucucucgcggugacccugaugcuggccauuuucaucguuuacauggugucccgggauaacgucagcuguuccauuugccucuga

SEQ ID NO: 210754 - RNA, 1755 nt, Artificial Sequence
  derived and/or modified sequence opt5 from hemagglutinin__InfluenzaB__AGX24128
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacuguauccaugagaaauacggaggccugaacaaguccaaaccuuauuacaccggcgaacacgcgaaggccauugggaacugcccgaucugggugaagacaccccugaaacucgcuaauggaaccaaguaucggccucccgccaaacugcuuaaggagcgcggcuuuuucggggcuauugccggauuucuggagggcgggugggaaggcaugaucgccggauggcacggcuacacaucucauggggcucacggaguugcgguggccgcugaccucaaaagcacgcaggaggccaucaacaagauuaccaagaaucugaacucccuuagcgaacuggaggucaaaaaucuccaaagacugucuggcgccauggaugaacugcauaacgagauccucgagcuggacgaaaagguggaugaccuucgggcugauacaauuuccagccagaucgagcuggccguccuccugucuaaugaagggauuaucaacagcgaggacgaacaccuucuggcgcucgagcgcaaacugaagaaaaugcugggaccuuccgcuguggauaucggcaauggguguuucgagaccaagcacaagugcaaccagacaugccucgacagaauugccgccggcaccuuuaaugcuggagaguucucucugcccacguuugauagccuuaacaucaccgccgcuucccugaaugacgauggccucgacaaccauacaauucugcuguauuacagcaccgccgcgucuucccuugccguuacacucaugcuggcuaucuucauuguguauauggucagccgggacaaugugucuuguuccaucugccuguga

SEQ ID NO: 210755 - RNA, 1755 nt, Artificial Sequence; identical to SEQ ID NO: 209450
  derived and/or modified sequence opt5 from hemagglutinin__InfluenzaB__AGX24139

SEQ ID NO: 210756 - RNA, 1755 nt, Artificial Sequence
  derived and/or modified sequence opt5 from hemagglutinin__InfluenzaB__AGX24150
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccuauugccucaacuguacagaucuggacguggcucuuggaagaccuaugugcgucggcaccacacccucugccaaagccagcauucugcaugaagugcggccuguuaccuccggguguuuucccaucaugcacgaucgcacgaagaucagacaacucccuaaucugcugcggggauacgagaacauucgccucucuacacagaaugugaucgacgcugaaaaggccccgggcggccccuauagacuggggaccagcggauccugcccuaacgcuacaagcaaaucuggcuucuuugccaccauggcgugggccguccccaaggauaauaacaaaaaugcuaccaacccucuuacaguggaggugcccuacauuuguacggaaggggaggaccagaucaccgucuggggauuccauuccgauaauaagacacagaugaaaaaccuguauggcgacagcaauccgcaaaaguuuaccucuuccgccaacgggguuacaacccacuacgugagccagauuggaucuuucccugaucagacggaggacggcggccucccccaguccgggcggaucguggucgauuauaugaugcaaaagccuggaaaaacaggcaccauuguguaccagcgcgggauccugcuuccccagaagguuuggugcgcuagcggaagauccaaagugaucaagggcucucugccccucauuggggaagccgacugucugcaugagaaauacggaggccugaacaagagcaaaccuuauuacaccggcgaacacgcgaaggccaucgggaauugcccgauuugggucaagacaccccucaaacuggcuaacggaaccaaguaucggccucccgccaaacuucugaaggagcgcggcuuuuucggggcuaucgccggauuucucgagggcgggugggaaggcaugauugccggauggcacggcuacacaucccauggggcucacggaguggcgguugccgcugaucugaaaagcacgcaggaggccaucaauaagaucaccaagaaccuuaauucucuguccgaacucgaggugaaaaaccugcaaagacugagcggcgccauggacgaacuccauaaugagauucuggagcuugacgaaaaggucgaugaccugcgggcugauacaaucucuagccagauugagcucgccgugcugcuuuccaacgaagggaucauuaauucugaggacgaacaucugcucgcgcuggagcgcaaacugaagaaaaugcucggaccuagcgcugucgagaucggcaacggguguuucgaaaccaagcacaagugcaaucagacaugccuggauagaaucgccgccggcaccuuuaacgcuggagaguucucccuucccacguuugacagccugaauauuaccgccgcuucucucaacgaugacggccuggauaaucacacaauccugcuuuauuacuccaccgccgcgagcucucucgccgugacacugaugcuggcuauuuucaucguuuauauggugucccgggacaacgucagcuguuccauuugccucuga

SEQ ID NO: 210757 - RNA, 1755 nt, Artificial Sequence; identical to SEQ ID NO: 210071
  derived and/or modified sequence opt5 from hemagglutinin__InfluenzaB__AGX24161

SEQ ID NO: 210758 - RNA, 1755 nt, Artificial Sequence; identical to SEQ ID NO: 209844
  derived and/or modified sequence opt5 from hemagglutinin__InfluenzaB__AGX24172

SEQ ID NO: 210759 - RNA, 1755 nt, Artificial Sequence; identical to SEQ ID NO: 209844
  derived and/or modified sequence opt5 from hemagglutinin__InfluenzaB__AGX24183

SEQ ID NO: 210760 - RNA, 1755 nt, Artificial Sequence; identical to SEQ ID NO: 209844
  derived and/or modified sequence opt5 from hemagglutinin__InfluenzaB__AGX24194

SEQ ID NO: 210761 - RNA, 1755 nt, Artificial Sequence; identical to SEQ ID NO: 209591
  derived and/or modified sequence opt5 from hemagglutinin__InfluenzaB__AGX24205

SEQ ID NO: 210762 - RNA, 1755 nt, Artificial Sequence; identical to SEQ ID NO: 209755
  derived and/or modified sequence opt5 from hemagglutinin__InfluenzaB__AGX24227

SEQ ID NO: 210763 - RNA, 1755 nt, Artificial Sequence; identical to SEQ ID NO: 209844
  derived and/or modified sequence opt5 from hemagglutinin__InfluenzaB__AGX24238

SEQ ID NO: 210764 - RNA, 1755 nt, Artificial Sequence
  derived and/or modified sequence opt5 from hemagglutinin__InfluenzaB__AGX24249
augaaggccaucauugugcugcucauggucguuaccagcaacgcugacagaaucugcacaggcauuacguccucuaaaagcccccacguggugaagaccgccacacagggggaagucaaugugaccggaguuaucccucugacaaccacaccgaccaaauccuacuucgcgaaccuuaagggcacgcggacccgcgggaaacugugucccgauugccucaauuguacagaccuggauguggcucuuggaagaccuaugugcgucggcaccacacccucugccaaggccagcauucugcaugaagugcggccuguuaccuccggguguuuucccaucaugcacgaccgcacgaagaucagacaacucccuaaccugcugcggggauaugagaauauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaauaaaacacagaugaagaaccuguauggcgauuccaauccgcaaaaguuuaccagcucugccaacgggguuacaacccacuacgugucccagaucggagacuucccugaucagacggaggacggcggccucccccagagcgggcggauuguggucgauuauaugaugcaaaaaccuggaaagacaggcaccaucguguaccagcgcgggguucugcuuccccagaaaguguggugcgcuucuggaagauccaaggucaucaaaggcagccugccccucauuggggaagccgacugucugcaugagaaguacggaggccugaauaaauccaagccuuauuacaccggcgaacacgcgaaggccaucgggaacugcccgauuugggugaaaacaccccucaagcuggcuaacggaaccaaauaucggccucccgccaagcugcugaaagagcgcggcuuuuucggggcuaucgccggauuucucgagggcgggugggaaggcaugauugccggauggcacggcuacacaucucauggggcucacggaguugcgguggccgcugaccuuaagagcacgcaggaggccaucaauaagaucaccaaaaaccuuaauucccugagcgaacucgaggucaagaaccugcaaagacugucuggcgccauggaugaacuccauaaugagauucuggagcuugacgaaaaaguggaugaccugcgggcugauacaaucuccagccagauugagcucgccguccugcuuucuaacgaagggaucauuaauagcgaggacgaacaucugcucgcgcuggagcgcaagcugaaaaagaugcucggaccuuccgcuguggauaucggcaacggguguuucgagaccaagcacaaaugcaaucagacaugccuggacagaaucgccgccggcaccuuuaacgcuggagaguucucucuucccacguuugauagccugaauauuaccgccgcuucccucaacgacgauggccuggacaaucacacaauccugcuuuauuacagcaccgccgcgucuucccucgccguuacacugaugcuggcuauuuucaucguguauauggucagccgggacaacgugucuuguuccauuugccucuga

SEQ ID NO: 210765 - RNA, 1755 nt, Artificial Sequence; identical to SEQ ID NO: 209591
  derived and/or modified sequence opt5 from hemagglutinin__InfluenzaB__AGX24260

SEQ ID NO: 210766 - RNA, 1755 nt, Artificial Sequence; identical to SEQ ID NO: 210080
  derived and/or modified sequence opt5 from hemagglutinin__InfluenzaB__AGX24271

SEQ ID NO: 210767 - RNA, 1755 nt, Artificial Sequence
  derived and/or modified sequence opt5 from hemagglutinin__InfluenzaB__AGX24282
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacgaagggggaagaucagaucaccgucuggggauuccauuccgacaauaaaacacagaugaagaaccuguacggcgauagcaauccgcaaaaguuuaccucuuccgccaacgggguuacaacccacuaugugagccagauuggaucuuucccugaccagacggaggauggcggccucccccaguccgggcggaucguggucgacuacaugaugcaaaaaccuggaaagacaggcaccauuguguaucagcgcgggguucugcuuccccagagaguguggugcgcuagcggacgguccaaagucaucaagggcucucugccccucaucggggaggccgauugucugcaugaaaaauacggaggccugaacaagagcaaaccuuacuauaccggcgagcacgcgaaggccauugggaauugcccgaucugggugaagacaccccucaaacuggcuaacggaaccaaguaccgcccucccgccaaacuucugaaggaaagaggcuuuuucggggcuauugccggauuucucgagggcgggugggagggcaugaucgccggauggcacggcuauacaucccauggggcucacggaguugcgguggccgcugaccugaaaagcacgcaggaagccauuaauaagaucaccaagaaccuuaauucucuguccgagcucgaagucaaaaaccugcaacggcugagcggcgccauggacgagcuccauaaugaaauccuggagcuugaugagaagguggacgaucugcgcgcugacacaauuucuagccagaucgaacucgccguccugcuuuccaacgaggggauuaucaauucugaagaugagcaucugcucgcgcuggaaagaaaacugaagaaaaugcucggaccuagcgcuguggagauuggcaacggguguuucgagaccaagcacaagugcaaucagacaugccuggaccggaucgccgccggcaccuuuaacgcuggagaguucucccuucccacguuugauagccugaauaucaccgccgcuucucucaacgacgauggccuggacaaucacacaauucugcuuuacuauuccaccgccgcgagcucucucgccguuacacugaugcuggcuaucuucauuguguacauggucuccagagauaacgugagcuguuccaucugccucuga

SEQ ID NO: 210768 - RNA, 1755 nt, Artificial Sequence; identical to SEQ ID NO: 209591
  derived and/or modified sequence opt5 from hemagglutinin__InfluenzaB__AGX24293

SEQ ID NO: 210769 - RNA, 1755 nt, Artificial Sequence; identical to SEQ ID NO: 209591
  derived and/or modified sequence opt5 from hemagglutinin__InfluenzaB__AGX24304

SEQ ID NO: 210770 - RNA, 1755 nt, Artificial Sequence; identical to SEQ ID NO: 210080
  derived and/or modified sequence opt5 from hemagglutinin__InfluenzaB__AGX24315

SEQ ID NO: 210771 - RNA, 1755 nt, Artificial Sequence
  derived and/or modified sequence opt5 from hemagglutinin__InfluenzaB__AGX24326
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaccugcgucggcacaacccccucugccaaagccagcauucugcaugaagugcggccuguuacguccggguguuuucccaucaugcacgaccgcacaaagaucagacaacucccuaaucugcugcggggauaugagaacauucgccucucuacccagaaugugaucgaugcugaaaaggccccgggcggccccuacagacuggggacaagcggauccugcccuaacgcuaccagcaaaucuggcuucuuugccaccauggcgugggccguccccaaggacaauaacaaaaaugcuacaaacccucuuacgguggaggugcccuauauuuguaccgaaggggaggaucagaucacagucuggggauuccauuccgacaauaagacccagaugaaaaaccuguacggcgauagcaauccgcaaaaguuuacaucuuccgccaacgggguuaccacgcacuaugugagccagauuggaucuuucccugaccagacagaggauggcggccucccccaguccgggcggaucguggucgacuacaugaugcaaaagccuggaaaaaccggcaccauuguguaucagcgcgggauccugcuuccccagaagguuuggugcgcuagcggaagauccaaagugaucaagggcucucugccccucauuggggaagccgauugucugcaugagaaauacggaggccugaacaagagcaaaccuuacuauacaggcgaacacgcgaaggccaucgggaauugcccgauuugggucaagacaccccucaaacuggcuaacggaaccaaguaccggccucccgccaaacuucugaaggagcgcggcuuuuucggggcuaucgccggauuucucgagggcgggugggaaggcaugauugccggauggcacggcuauacgucccauggggcucacggaguggcgguugccgcugaccugaaaagcacccaggaggccaucaauaagaucacaaagaaccuuaauucucuguccgaacucgaggugaaaaaccugcaaagacugagcggcgccauggacgaacuccauaaugagauucuggagcuugaugaaaaggucgacgaucugcgggcugacaccaucucuagccagauugagcucgccgugcugcuuuccaacgaagggaucauuaauucugaggaugaacaucugcucgcgcuggagcgcaaacugaagaaaaugcucggaccuagcgcugucgagaucggcaacggguguuucgaaacaaagcacaagugcaaucagaccugccuggacagaaucgccgccggcacguuuaacgcuggagaguucucccuucccaccuuugauagccugaauauuacagccgcuucucucaacgacgauggccuggacaaucacaccauccugcuuuacuauuccacagccgcgagcucucucgccgugacccugaugcuggcuauuuucaucguuuacauggugucccgggauaacgucagcuguuccauuugccucuga

SEQ ID NO: 210772 - RNA, 1755 nt, Artificial Sequence
  derived and/or modified sequence opt5 from hemagglutinin__InfluenzaB__AGX24337
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaaugccuaugugcgucggcaccacacccucugccaaagccagcauucugcaugaagugagaccuguuaccuccggguguuuucccaucaugcacgaccggacgaagauccgccaacucccuaaucugcugagaggauaugagaacauucggcucucuacacagaaugugaucgaugcugaaaaggccccgggcggccccuaccgccuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggagaauuguggucgauuauaugaugcaaaagccuggaaaaacaggcaccaucguguaccagcgcgggguucugcuuccccagaagguguggugcgcuucuggacgguccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguauagaccucccgccaaacuucugaaggagcggggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaacgccugucuggcgccauggaugaacuccauaacgagauucuggagcuugacgaaaagguggaugaccugagagcugauacaaucuccagccagauugagcucgccguccugcuuucuaaugaagggaucauuaacagcgaggacgaacaucugcucgcgcuggagcggaaacugaagaaaaugcucggaccuuccgcuguggauaucggcaauggguguuucgagaccaagcacaagugcaaccagacaugccuggaccgcaucgccgccggcaccuuuaaugcuggagaguucucucuucccacguuugauagccugaacauuaccgccgcuucccucaaugacgauggccuggacaaccacacaauccugcuuuauuacagcaccgccgcgucuucccucgccguuacacugaugcuggcuauuuucaucguguauauggucagcagagacaaugugucuuguuccauuugccucuga

SEQ ID NO: 210773 - RNA, 1755 nt, Artificial Sequence; identical to SEQ ID NO: 209844
  derived and/or modified sequence opt5 from hemagglutinin__InfluenzaB__AGX24348

SEQ ID NO: 210774 - RNA, 1755 nt, Artificial Sequence; identical to SEQ ID NO: 209591
  derived and/or modified sequence opt5 from hemagglutinin__InfluenzaB__AGX24359

SEQ ID NO: 210775 - RNA, 1755 nt, Artificial Sequence; identical to SEQ ID NO: 209844
  derived and/or modified sequence opt5 from hemagglutinin__InfluenzaB__AGX24381

SEQ ID NO: 210776 - RNA, 1755 nt, Artificial Sequence
  derived and/or modified sequence opt5 from hemagglutinin__InfluenzaB__AGX24392
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggagauucccuauaucuguacggaaggggaggaucagauuaccguguggggauuccauuccgacaauaagacacagaugaaaaaccuguacggcgauagcaauccgcaaaaguuuaccucuuccgccaacggggucacaacccacuauguuagccagaucggaucuuucccugaccagacggaggauggcggccucccccaguccgggcggauugugguggacuacaugaugcaaaagccuggaaaaacaggcaccaucgucuaucagcgcggggugcugcuuccccagaagguuuggugcgcuagcggaagauccaaagugaucaagggcucucugccccucauuggggaagccgauugucugcaugagaaauacggaggccugaacaagagcaaaccuuacuauaccggcgaacacgcgaaggccaucgggaauugcccgauuugggucaagacaccccucaaacuggcuaacggaaccaaguaccggccucccgccaaacuucugaaggagcgcggcuuuuucggggcuaucgccggauuucucgagggcgggugggaaggcaugauugccggauggcacggcuauacaucccauggggcucacggaguggcgguugccgcugaccugaaaagcacgcaggaggccaucaauaagaucaccaagaaccuuaauucucuguccgaacucgaggugaaaaaccugcaaagacugagcggcgccauggacgaacuccauaaugagauucuggagcuugaugaaaaggucgacgaucugcgggcugacacaaucucuagccagauugagcucgccgugcugcuuuccaacgaagggaucauuaauucugaggaugaacaucugcucgcgcuggagcgcaaacugaagaaaaugcucggaccuagcgcugucgagaucggcaacggguguuucgaaaccaagcacaagugcaaucagacaugccuggacagaaucgccgccggcaccuuuaacgcuggagaguucucccuucccacguuugauagccugaauauuaccgccgcuucucucaacgacgauggccuggacaaucacacaauccugcuuuacuauuccaccgccgcgagcucucucgccgugacacugaugcuggcuauuuucaucguuuacauggugucccgggauaacgucagcuguuccauuugccucuga

SEQ ID NO: 210777 - RNA, 1755 nt, Artificial Sequence; identical to SEQ ID NO: 209591
  derived and/or modified sequence opt5 from hemagglutinin__InfluenzaB__AGX24403

SEQ ID NO: 210778 - RNA, 1755 nt, Artificial Sequence; identical to SEQ ID NO: 209844
  derived and/or modified sequence opt5 from hemagglutinin__InfluenzaB__AGX24414

SEQ ID NO: 210779 - RNA, 1755 nt, Artificial Sequence; identical to SEQ ID NO: 209591
  derived and/or modified sequence opt5 from hemagglutinin__InfluenzaB__AGX24425

SEQ ID NO: 210780 - RNA, 1755 nt, Artificial Sequence; identical to SEQ ID NO: 209591
  derived and/or modified sequence opt5 from hemagglutinin__InfluenzaB__AGX24436

SEQ ID NO: 210781 - RNA, 1755 nt, Artificial Sequence; identical to SEQ ID NO: 210080
  derived and/or modified sequence opt5 from hemagglutinin__InfluenzaB__AGX24447

SEQ ID NO: 210782 - RNA, 1755 nt, Artificial Sequence; identical to SEQ ID NO: 210771
  derived and/or modified sequence opt5 from hemagglutinin__InfluenzaB__AGX24458

SEQ ID NO: 210783 - RNA, 1755 nt, Artificial Sequence
  derived and/or modified sequence opt5 from hemagglutinin__InfluenzaB__AGX24469
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaccugcgucggcacaacccccucugccaaagccagcauucugcaugaagugcggccuguuacguccggguguuuucccaucaugcacgaccgcacaaagaucagacaacucccuaaucugcugcggggauaugagaacauucgccucucuacccagaaugugaucgaugcugaaaaggccccgggcggccccuacagacuggggacaagcggauccugcccuaacgcuaccagcaaaucuggcuucuuugccaccauggcgugggccguccccaaggacaauaacaaaaaugcuacaaacccucuuacgguggaggugcccuauauuuguaccgaaggggaggaucagaucacagucuggggauuccauuccgacaauaagacccagaugaaaaaccuguacggcgauagcaauccgcaaaaguuuacaucuuccgccaacgggguuaccacgcacuaugugagccagauuggaucuuucccugaccagacagaggauggcggccucccccaguccgggcggaucguggucgacuacaugaugcaaaagccuggaaaaaccggcaccauuguguaucagcgcgggauccugcuuccccagaagguuuggugcgcuagcggaagauccaaagugaucaagggcucucugccccucauuggggaagccgauugucugcaugagaaauacggaggccugaacaagagcaaaccuuacuauacaggcgaacacgcgaaggccaucgggaauugcccgauuugggucaagacaccccucaaacuggcuaacggaaccaaguaccggccucccgccaaacuucugaaggagcgcggcuuuuucggggcuaucgccggauuucucgagggcgggugggaaggcaugguggccggauggcacggcuauacgucccauggggcucacggaguugcgguggccgcugaccugaaaagcacccaggaggccauuaauaagaucacaaagaaccuuaauucucuguccgaacucgaggucaaaaaccugcaaagacugagcggcgccauggacgaacuccauaaugagauccuggagcuugaugaaaagguggacgaucugcgggcugacaccauuucuagccagaucgagcucgccguccugcuuuccaacgaagggauuaucaauucugaggaugaacaucugcucgcgcuggagcgcaaacugaagaaaaugcucggaccuagcgcuguggagauuggcaacggguguuucgaaacaaagcacaagugcaaucagaccugccuggacagaaucgccgccggcacguuuaacgcuggagaguucucccuucccaccuuugauagccugaauaucacagccgcuucucucaacgacgauggccuggacaaucacaccauucugcuuuacuauuccacagccgcgagcucucucgccguuacccugaugcuggcuaucuucauuguguacauggucucccgggauaacgugagcuguuccaucugccucuga

SEQ ID NO: 210784 - RNA, 1755 nt, Artificial Sequence; identical to SEQ ID NO: 210080
  derived and/or modified sequence opt5 from hemagglutinin__InfluenzaB__AGX24480

SEQ ID NO: 210785 - RNA, 1755 nt, Artificial Sequence; identical to SEQ ID NO: 210080
  derived and/or modified sequence opt5 from hemagglutinin__InfluenzaB__AGX24491

SEQ ID NO: 210786 - RNA, 1755 nt, Artificial Sequence
  derived and/or modified sequence opt5 from hemagglutinin__InfluenzaB__AGX24502
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccagaaggacaauaacaaaaaugcuaccaacccccuuacaguggaggugccuuauauuuguacggaaggggaggaucagaucaccgucuggggauuccauuccgacaauaagacacaaaugaaaaaccuguacggcgauagcaauccccagaaguuuaccucuuccgccaacgggguuacaacccacuaugugagccagauuggaucuuucccggaccagacggaggauggcggccucccucaauccgggcggaucguggucgacuacaugaugcagaagcccggaaaaacaggcaccauuguguaucagcgcgggguucugcuuccucagagaguguggugcgcuagcggacgguccaaggucaucaaaggcucucugccccucaucggggaagccgauugucugcaugagaaguacggaggccugaacaaaagcaagcccuacuauaccggcgaacacgcgaaagccauugggaauugcccuaucugggugaagacaccgcucaagcuggcuaacggaaccaaauacagacccccugccaagcugcugaaagagcgcggcuuuuucggggcuauugccggauuucucgagggcgggugggaaggcaugaucgccggauggcacggcuauacaucccauggggcucacggaguugcgguggccgcugaccuuaagagcacgcaagaggccauuaauaaaaucaccaagaaccuuaauucucuguccgaacucgaggucaagaaccugcagcggcugagcggcgccauggacgaacuccauaaugagauccuggagcuugaugaaaaaguggacgaucugcgcgcugacacaauuucuagccagaucgagcucgccguccugcuuuccaacgaagggauuaucaauucugaggaugaacaucugcucgcgcuggagagaaagcugaaaaagaugcucggacccagcgcuguggagauuggcaacggguguuucgaaaccaaacacaagugcaaucaaacaugccuggaccggaucgccgccggcaccuuuaacgcuggagaguucucccuuccuacguuugauagccugaauaucaccgccgcuucucucaacgacgauggccuggacaaucacacaauucugcuuuacuauuccaccgccgcgagcucucucgccguuacacugaugcuggcuaucuucauuguguacauggucuccagagauaacgugagcuguuccaucugccucuga

SEQ ID NO: 210787 - RNA, 1755 nt, Artificial Sequence; identical to SEQ ID NO: 209755
  derived and/or modified sequence opt5 from hemagglutinin__InfluenzaB__AGX24513

SEQ ID NO: 210788 - RNA, 1755 nt, Artificial Sequence; identical to SEQ ID NO: 210080
  derived and/or modified sequence opt5 from hemagglutinin__InfluenzaB__AGX24524

SEQ ID NO: 210789 - RNA, 1755 nt, Artificial Sequence
  derived and/or modified sequence opt5 from hemagglutinin__InfluenzaB__AGX24535
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaaagacugucuggcgccauggaugaacuccauaacgagauucuggagcuugacgaaaagguggaugaccugcgggcugauacaaucuccgcccagauugagcucgcgguccugcuuagcaaugaagggaucauuaacucugaggacgaacaucugcucgcucuggagcgcaaacugaagaaaaugcucggaccuagcgccguggauaucggcaauggguguuucgagaccaagcacaagugcaaccagacaugccuggacagaaucgccgcuggcaccuuuaaugccggagaguucucccuucccacguuugauucucugaacauuaccgcugccagccucaaugacgauggccuggacaaccacacaauccugcuuuauuacuccaccgcggccagcucucucgcuguuacacugaugcuggccauuuucaucguguauauggucucccgggacaaugugagcuguucuauuugccucuga

SEQ ID NO: 210790 - RNA, 1755 nt, Artificial Sequence; identical to SEQ ID NO: 209591
  derived and/or modified sequence opt5 from hemagglutinin__InfluenzaB__AGX24546

SEQ ID NO: 210791 - RNA, 1755 nt, Artificial Sequence
  derived and/or modified sequence opt5 from hemagglutinin__InfluenzaB__AGX24557
augaagaccaucauugugcugcucauggucguuacaagcaacgccgacagaaucugcacgggcauuaccuccucuaauagcccccacguggugaaaacagcuacccagggggaggucaacgugacaggaguuaucccucugaccacaaccccgacgaaguccuacuucgccaaucuuaaaggcacccggacacgcgggaagcugugucccgauugccucaacuguaccgaccuggauguggcgcuuggaagaccuacaugcgucggcaccacgcccucugcuaaagccagcauucugcaugaagugcggccuguuacauccggguguuuucccaucaugcacgaccgcaccaagaucagacaacucccuaaucugcugcggggauaugagaacauucgccucucuacacagaaugugaucgaugccgaaaaggcuccgggcggccccuacagacuggggaccagcggauccugcccuaacgccaccagcaaaucuggcuucuuugcuacaauggccugggcgguccccaaggacaauaacaaaaaugccacgaacccucuuaccguggaggugcccuauauuuguacagaaggggaggaucagaucaccgucuggggauuccauuccgacaauaagacacagaugaaaaaccuguacggcgauagcaauccgcaaaaguuuaccucuuccgcuaacgggguuacgacacacuaugugagccagauuggaucuuucccugaccagaccgaggauggcggccucccccaguccgggcggaucguggucgacuacaugaugcaaaagccuggaaaaaccggcacaauuguguaucagcgcgggauccugcuuccccagaagguuuggugcgccagcggaagauccaaagugaucaagggcucucugccccucauuggggaagcugauugucugcaugagaaauacggaggccugaacaagagcaaaccuuacuauaccggcgaacacgccaaggcgaucgggaauugcccgauuugggucaagacaccccucaaacuggccaacggaacgaaguaccggccucccgcuaaacuucugaaggagcgcggcuuuuucggggccaucgcuggauuucucgagggcgggugggaaggcaugauugccggauggcacggcuauaccucccauggggcccacggaguggcuguugcggccgaccugaaaagcacacaggaggcuaucaauaagaucaccaagaaccuuaauucucuguccgaacucgaggugaaaaaccugcaaagacugagcggcgccauggacgaacuccauaaugagauucuggagcuugaugaaaaggucgacgaucugcgggccgacacaaucucuagccagauugagcucgcugugcugcuuuccaacgaagggaucauuaauucugaggaugaacaucugcucgcccuggagcgcaaacugaagaaaaugcucggaccuagcgcggucgagaucggcaacggguguuucgaaaccaagcacaagugcaaucagacgugccuggacagaaucgcugccggcaccuuuaacgccggagaguucucccuucccacauuugauagccugaauauuaccgcugccucucucaacgacgauggccuggacaaucacacaauccugcuuuacuauuccaccgcugccagcucucucgcggugacgcugaugcuggccauuuucaucguuuacauggugucccgggauaacgucagcuguuccauuugccucuga

SEQ ID NO: 210792 - RNA, 1755 nt, Artificial Sequence; identical to SEQ ID NO: 210080
  derived and/or modified sequence opt5 from hemagglutinin__InfluenzaB__AGX24579

SEQ ID NO: 210793 - RNA, 1755 nt, Artificial Sequence; identical to SEQ ID NO: 210080
  derived and/or modified sequence opt5 from hemagglutinin__InfluenzaB__AGX24590

SEQ ID NO: 210794 - RNA, 1755 nt, Artificial Sequence; identical to SEQ ID NO: 210080
  derived and/or modified sequence opt5 from hemagglutinin__InfluenzaB__AGX24601

SEQ ID NO: 210795 - RNA, 1755 nt, Artificial Sequence; identical to SEQ ID NO: 210080
  derived and/or modified sequence opt5 from hemagglutinin__InfluenzaB__AGX24612

SEQ ID NO: 210796 - RNA, 1755 nt, Artificial Sequence; identical to SEQ ID NO: 209591
  derived and/or modified sequence opt5 from hemagglutinin__InfluenzaB__AGX24623

SEQ ID NO: 210797 - RNA, 1755 nt, Artificial Sequence; identical to SEQ ID NO: 210080
  derived and/or modified sequence opt5 from hemagglutinin__InfluenzaB__AGX24634

SEQ ID NO: 210798 - RNA, 1755 nt, Artificial Sequence; identical to SEQ ID NO: 210789
  derived and/or modified sequence opt5 from hemagglutinin__InfluenzaB__AGX24656

SEQ ID NO: 210799 - RNA, 1755 nt, Artificial Sequence; identical to SEQ ID NO: 209591
  derived and/or modified sequence opt5 from hemagglutinin__InfluenzaB__AGX24667

SEQ ID NO: 210800 - RNA, 1755 nt, Artificial Sequence; identical to SEQ ID NO: 209844
  derived and/or modified sequence opt5 from hemagglutinin__InfluenzaB__AGX24678

SEQ ID NO: 210801 - RNA, 1755 nt, Artificial Sequence; identical to SEQ ID NO: 210080
  derived and/or modified sequence opt5 from hemagglutinin__InfluenzaB__AGX24689

SEQ ID NO: 210802 - RNA, 1755 nt, Artificial Sequence; identical to SEQ ID NO: 210080
  derived and/or modified sequence opt5 from hemagglutinin__InfluenzaB__AGX24700

SEQ ID NO: 210803 - RNA, 1755 nt, Artificial Sequence; identical to SEQ ID NO: 210080
  derived and/or modified sequence opt5 from hemagglutinin__InfluenzaB__AGX24711

SEQ ID NO: 210804 - RNA, 1755 nt, Artificial Sequence; identical to SEQ ID NO: 209591
  derived and/or modified sequence opt5 from hemagglutinin__InfluenzaB__AGX24722

SEQ ID NO: 210805 - RNA, 1755 nt, Artificial Sequence; identical to SEQ ID NO: 209591
  derived and/or modified sequence opt5 from hemagglutinin__InfluenzaB__AGX24733

SEQ ID NO: 210806 - RNA, 1755 nt, Artificial Sequence; identical to SEQ ID NO: 209591
  derived and/or modified sequence opt5 from hemagglutinin__InfluenzaB__AGX24744

SEQ ID NO: 210807 - RNA, 1755 nt, Artificial Sequence; identical to SEQ ID NO: 209591
  derived and/or modified sequence opt5 from hemagglutinin__InfluenzaB__AGX24755

SEQ ID NO: 210808 - RNA, 1755 nt, Artificial Sequence; identical to SEQ ID NO: 210080
  derived and/or modified sequence opt5 from hemagglutinin__InfluenzaB__AGX24766

SEQ ID NO: 210809 - RNA, 1755 nt, Artificial Sequence; identical to SEQ ID NO: 209591
  derived and/or modified sequence opt5 from hemagglutinin__InfluenzaB__AGX24777

SEQ ID NO: 210810 - RNA, 1755 nt, Artificial Sequence; identical to SEQ ID NO: 209591
  derived and/or modified sequence opt5 from hemagglutinin__InfluenzaB__AGX24788

SEQ ID NO: 210811 - RNA, 1755 nt, Artificial Sequence; identical to SEQ ID NO: 209591
  derived and/or modified sequence opt5 from hemagglutinin__InfluenzaB__AGX24799

SEQ ID NO: 210812 - RNA, 1755 nt, Artificial Sequence; identical to SEQ ID NO: 210080
  derived and/or modified sequence opt5 from hemagglutinin__InfluenzaB__AGX24810

SEQ ID NO: 210813 - RNA, 1755 nt, Artificial Sequence; identical to SEQ ID NO: 210080
  derived and/or modified sequence opt5 from hemagglutinin__InfluenzaB__AGX24821

SEQ ID NO: 210814 - RNA, 1755 nt, Artificial Sequence
  derived and/or modified sequence opt5 from hemagglutinin__InfluenzaB__AGX24832
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaucuuucccugaccagacggaggauggcggccucccccaguccgggcggaucguggucgacuacaugaugcaaaagccuggaaaaacaggcaccauuguguaucagcgcgggauccugcuuccccagagaguuuggugcgcuagcggacgguccaaggugaucaaaggcucucugccccucauuggggaagccgauugucugcaugagaaguacggaggccugaacaaaagcaagccuuacuauaccggcgaacacgcgaaagccaucgggaauugcccgauuugggucaagacaccccucaagcuggcuaacggaaccaaauaccgcccucccgccaagcugcugaaagagagaggcuuuuucggggcuaucgccggauuucucgagggcgggugggaaggcaugauugccggauggcacggcuauacaucccauggggcucacggaguggcgguugccgcugaccuuaagagcacgcaggaggccaucaauaaaaucaccaagaaccuuaauucucuguccgaacucgaggugaagaaccugcaacggcugagcggcgccauggacgaacuccauaaugagauucuggagcuugaugaaaaagucgacgaucugcgcgcugacacaaucucuagccagauugagcucgccgugcugcuuuccaacgaagggaucauuaauucugaggaugaacaucugcucgcgcuggagagaaagcugaaaaagaugcucggaccuagcgcugucgagaucggcaacggguguuucgaaaccaaacacaagugcaaucagacaugccuggaccggaucgccgccggcaccuuuaacgcuggagaguucucccuucccacguuugauagccugaauauuaccgccgcuucucucaacgacgauggccuggacaaucacacaauccugcuuuacuauuccaccgccgcgagcucucucgccgugacacugaugcuggcuauuuucaucguuuacaugguguccagagauaacgucagcuguuccauuugccucuga

SEQ ID NO: 210815 - RNA, 1755 nt, Artificial Sequence
  derived and/or modified sequence opt5 from hemagglutinin__InfluenzaB__AGX24843
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauauggugcaaaagccuggaaaaacaggcaccaucguuuaccagcgcggggugcugcuuccccagagagucuggugcaccucuggacgguccaaggugaucaaaggcagccugccccucauuggggaagcugacugucugcaugagaaguacggaggccugaacaaauccaagccuuauuacacaggcgaacacgccaaagcgaucgggaacugcccgauuuggguuaagacaccccucaagcuggccaauggaaccaaauaucgcccucccgcuaagcugcugaaagagagaggcuuuuucggggccaucgcuggauuucucgagggcgggugggaaggcaugauugccggauggcacggcuacacgucucauggggcccacggaguggcugucgcggccgaccuuaagagcacccaggaggcuaucaacaaaaucacaaagaaucuuaacucccugagcgaacucgaggugaagaaucugcaacggcugucuggcgccauggaugaacuccauaacgagauucuggagcuugacgaaaaagucgaugaccugcgcgccgauaccaucuccagccagauugagcucgcugugcugcuuucuaaugaagggaucauuaacagcgaggacgaacaucugcucgcccuggagagaaagcugaaaaagaugcucggaccuuccgcgguugauaucggcaauggguguuucgagacaaaacacaagugcaaccagaccugccuggaccggaucgcugccggcacguuuaaugccggagaguucucucuucccaccuuugauagccugaacauuacagcugccucccucaaugacgauggccuggacaaccacaccauccugcuuuauuacagcacagcugccucuucccucgcggugacccugaugcuggccauuuucaucgucuauauggugagcagagacaauguuucuuguuccauuugccucuga

SEQ ID NO: 210816 - RNA, 1755 nt, Artificial Sequence
  derived and/or modified sequence opt5 from hemagglutinin__InfluenzaB__AGX24854
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgaaugccucaacuguacagaucuggacguggcucuuggaagaccuaugugcgucggcaccacacccucugccaaagccagcauucugcaugaggugcggccuguuaccuccggguguuuucccaucaugcacgaucgcacgaagaucagacaacucccuaaucugcugcggggauaugaaaacauucgccucucuacacagaaugugaucgacgcugagaaggccccgggcggccccuacagacuggggaccagcggauccugcccuaacgcuacaagcaaaauuggcuucuuugccaccauggcgugggccguccccaaggauaauuauaaaaacgcuaccaauccucuuacaguggaagugcccuacaucugugccgagggggaggaccagauuacggucuggggauuccauucugauaacaagacccagaugaaaaaucuguauggcgacuccaacccgcaaaaguuuacaagcucugcuaaugggguuaccacacacuacgugucccagaucggagauuucccugaccagaccgaagauggcggccucccccagagcgggcggauuguggucgacuauauggugcaacgcccuggaaagacgggcacaaucguuuaccagagaggggugcugcuuccccagaaagucuggugcgccucuggacgguccaaggugaucaaaggcagccugccccucauuggggaggcggauugucugcaugaaaaguacggaggccugaacaaauccaagccuuauuacaccggcgagcacgccaaagcuaucgggaacugcccgauuuggguuaagacaccccucaagcuggccaauggaaccaaauaucgcccucccgcuaagcugcugaaagagagaggcuuuuucggggccaucgccggauuucucgaaggcgggugggagggcaugauugcuggauggcacggcuacaccucucauggggcgcacggaguggccgucgcugccgaccuuaagagcacacaggaagccaucaacaaaaucacgaagaaucuuaacucccugagcgagcucgaagugaagaaucugcaacggcugucuggcgcuauggacgagcuccauaacgagauucuggaacuugaugagaaagucgacgaucugcgcgccgacaccaucuccagccagauugaacucgcggugcugcuuucuaaugaggggaucauuaacagcgaagaugagcaucugcucgcucuggagagaaagcugaaaaagaugcucggaccuuccgccguugacaucggcaauggguguuucgaaacaaaacacaagugcaaccagaccugccuggaucggaucgccgcuggcacauuuaaugccggagaguucucucuucccaccuuugacagccugaacauuacggcugccucccucaaugaugacggccuggauaaccacaccauccugcuuuauuacagcacagcggccucuucccucgcugugacccugaugcuggccauuuucaucgucuauauggugagcagagacaauguuucuuguuccauuugccucuga

SEQ ID NO: 210817 - RNA, 1755 nt, Artificial Sequence
  derived and/or modified sequence opt5 from hemagglutinin__InfluenzaB__AGX24865
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucugugccgaaggggaggaucagauuacggucuggggauuccauucugacaacaagacccagaugaaaaaucuguauggcgauuccaacccgcaaaaguuuacaagcucugcuaaugggguuaccacacacuacgugucccagaucggagacuucccugaucagaccgaggacggcggccucccccagagcgggcggauuguggucgauuauauggugcaacgcccuggaaagacgggcacaaucguuuaccagagaggggugcugcuuccccagaaagucuggugcgccucuggacgguccaaggugaucaaaggcagccugccccucauuggggaagcggacugucugcaugagaaguacggaggccugaacaaauccaagccuuauuacaccggcgaacacgccaaagcuaucgggaacugcccgauuuggguuaagacaccccucaagcuggccaauggaaccaaauaucgcccucccgcuaagcugcugaaagagagaggcuuuuucggggccaucgccggauuucucgagggcgggugggaaggcaugauugcuggauggcacggcuacaccucucauggggcgcacggaguggccgucgcugccgaccuuaagagcacacaggaggccaucaacaaaaucacgaagaaucuuaacucccugagcgaacucgaggugaagaaucugcaacggcugucuggcgcuauggaugaacuccauaacgagauucuggagcuugacgaaaaagucgaugaccugcgcgccgauaccaucuccagccagauugagcucgcggugcugcuuucuaaugaagggaucauuaacagcgaggacgaacaucugcucgcucuggagagaaagcugaaaaagaugcucggaccuuccgccguugauaucggcaauggguguuucgagacaaaacacaagugcaaccagaccugccuggaccggaucgccgcuggcacauuuaaugccggagaguucucucuucccaccuuugauagccugaacauuacggcugccucccucaaugacgauggccuggacaaccacaccauccugcuuuauuacagcacagcggccucuucccucgcugugacccugaugcuggccauuuucaucgucuauauggugagcagagacaauguuucuuguuccauuugccucuga

SEQ ID NO: 210818 - RNA, 1755 nt, Artificial Sequence
  derived and/or modified sequence opt5 from hemagglutinin__InfluenzaB__AGX24876
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauucucuuacaguggaggugccuuacaucuguaaggaaggggaggaucagauuacggucuggggauuccauuccgacaacaaaccccagaugaagaaucuguauggcgauagcaacccgcaaaaguuuaccucuuccgccaaugggguuacaacccacuacgugagccaggugggagacuucccugaucagacagaggacggcggccucccccagucugggcggaucgucguggauuauaugaugcaaaaaccuggacgcaccggcacgauuguuuaccagagaggggugcugcuuccccagaaggucuggugcgcuuccggacggagcaaagugaucaagggcucccugccccucaucggggaagccgacugucugcaugagaaauacggaggccugaacaagucuaaaccuuauuacacaggcgaacacgcgaaggccauugggaacugcccgaucuggguuaagacaccccucaaacuggcuaauggaaccaaguaucgcccucccgccaaacuucugaaggagagaggcuuuuucggggcuauugccggauuucucgagggcgggugggaaggcaugaucgccggauggcacggcuacaccagccauggggcucacggaguggcggucgccgcugaccugaaauccacccaggaggccauuaacaagaucacaaagaaucuuaacagccugucugaacucgaggugaaaaaucugcaacggcuguccggcgccauggaugaacuccauaacgagauccuggagcuugacgaaaaggucgaugaccugcgcgcugauacgauuagcucucagaucgagcucgccgugcugcuuagcaaugaagggauuaucaacuccgaggacgaacaucugcucgcgcuggagagaaaacugaagaaaaugcucggaccuucugcuguugauauuggcaauggguguuucgagaccaagcacaagugcaaccagacaugccuggaccggaucgccgccggcaccuuuaaugcuggagaguucagccuucccacauuugauucccugaacaucaccgccgcuagccucaaugacgauggccuggacaaccacacgauucugcuuuauuacucuaccgccgcguccagccucgccgugacacugaugcuggcuaucuucauugucuauauggugucuagagacaauguuuccuguagcaucugccucuga

SEQ ID NO: 210819 - RNA, 1755 nt, Artificial Sequence
  derived and/or modified sequence opt5 from hemagglutinin__InfluenzaB__AGX24887
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaauuggcuucuuugcgaccauggccugggcugugcccaaggacaauuauaaaaacgccaccaauccucagacagucgaggugcccuacaucuguacggaaggggaggaucagauuaccguguggggauuccauucugacaacaagacacaaaugaaaaaucuuuauggcgauuccaacccgcagaaguuuaccagcucugcuaauggggucacaacccacuacguuucccagaucggagacuucccugaucagacggaggacggcggccugccccaaagcgggcggauugugguggauuauaugguccagaagccuggaaaaacaggcaccaucguguaccagcgcgggguucuccugccccagaagguguggugcgccucuggaagauccaaagucaucaagggcagccuuccccugauuggggaagcggacugucuccaugagaaauacggaggccugaacaaguccaaaccuuauuacaccggcgaacacgccaaggcuaucgggaacugcccgauuugggugaagacaccccugaaacucgccaauggaaccaaguaucggccucccgcuaaacugcuuaaggagcgcggcuuuuucggggccaucgccggauuucuggagggcgggugggaaggcaugauugcuggauggcacggcuacacaucucauggggcgcacggaguugccguggcugccgaccucaaaagcacgcaagaggccaucaacaagaucaccaagaaucugaacucccuuagcgaacuggaggucaaaaaucuccagagacugucuggcgcuauggaugaacugcauaacgagauucucgagcuggacgaaaagguggaugaccuucgggccgauacaauguccagccagaucgagcuggcgguccuccugucuaaugaagggauuaucaacagcgaggacgaacaccuucuggcucucgagcgcaaacugaagaaaaugcugggaccuuccgccguggauauuggcaauggguguuucgagaccaagcacaagugcaaccaaacaugccucgacagaaucgccgcuggcaccuuuaaugccggagaguucucucugcccacguuugauagccuuaacaucaccgcugccucccugaaugacgauggccucgacaaccauacaauucugcuguauuacagcaccgcggccucuucccuugcuguuacacucaugcuggccaucuucauuguguauauggucagccgggacaaugugucuuguuccaucugccuguga

SEQ ID NO: 210820 - RNA, 1755 nt, Artificial Sequence
  derived and/or modified sequence opt5 from hemagglutinin__InfluenzaB__AGX24898
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguaccgggggagaagaucagauuacggucuggggcuuccauucugacaauaaaacacagaugaagucccuguauggggauagcaacccgcaaaaguuuaccucuuccgccaauggaguuacaacccacuacgugagccagaucggcgacuucccugaucagacggaggacggcgggcucccccagucuggacggauuguggucgauuauaugaugcaaaaaccuggcaagacagggaccaucguguaccagcgcggaguucugcuuccccagaaaguguggugcgcuuccggcagaagcaaggucaucaaagggucccugccccucauuggagaggccgacugucugcaugaaaaguacggcggccugaacaaaucuaagccuuauuacaccggggagcacgcgaaggccaucggaaauugcccgauuugggugaaaacaccccucaagcuggcuaacggcaccaaauaucggccucccgccaagcugcugaaagaacgcggguuuuucggagcuaucgccggcuuucucgaagggggcugggagggaaugauugccggcuggcacggguacacaagccauggagcucacggcguugcgguggccgcugaccugaaguccacgcaggaggccaucaacaagaucaccaaaaaucuuaacagccugucugagcucgaagucaagaaucugcaaagacuguccggggccauggaugagcuccauaacgaaauucuggagcuugacgagaaaguggaugaccugcgggcugauacaaucagcucucagauugaacucgccguccugcuuagcaaugagggaaucauuaacuccgaagacgagcaccuucucgcgcuggaacgcaagcugaaaaagaugcucggcccuucugcuguggauaucgggaauggcuguuucgagaccaagcacaaaugcaaccagacaugccuggacagaaucgccgccggaaccuuuaaugcuggcgaguucagccuucccacguuugauucccugaacauuaccgccgcuagccucaaugacgaugggcuggacaaccauacaauccugcuuuauuacucuaccgccgcguccagccucgccguuacacugaugcuggcuauuuucaucguguauauggucucucgggacaauguguccuguagcauuugccucuga

SEQ ID NO: 210821 - RNA, 1758 nt, Artificial Sequence; identical to SEQ ID NO: 209707
  derived and/or modified sequence opt5 from hemagglutinin__InfluenzaB__AGX84854

SEQ ID NO: 210822 - RNA, 1758 nt, Artificial Sequence
  derived and/or modified sequence opt5 from hemagglutinin__InfluenzaB__AGX84865
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugcccuaacuguacagaucucgacguugcucugggacgccccaagugcaccggcaagaucccuucugccagagugagcauccuucacgagguccggcccgugacauccggguguuuuccuauuaugcaugaucgcaccaaaaucagacaacugccgaaucuccugcggggauacgaacacauucgccugucuacgcauaacguuaucaaugccgagaacgcucccggcggcccuuauaagauugggacaagcggauccugccccaaugugaccaacggcaauggguucuuugccacaauggcuugggccgucccuaaaaacgacaagaauaaaaccgcgaccaacccccucacaaucgaagugccguacauuuguacggagggagaggaucagaucaccguguggggcuuccacagcgacaaugaaacacagauggccaagcuguauggggauucuaagccucagaaauuuaccuccagcgcuaacggagucacaacccacuacguuucucaaaucggcggcuuccccaaccagacggaggacgggggacuuccucaguccggcagaauugugguggauuauaugguccaaaagagcgggaaaacaggaaccaucaccuaccagcggggcauucugcucccccagaagguguggugcgccucugggcgcuccaaaguuaucaagggaagccugccccuuauuggcgaagcugacugucugcaugagaaauauggcgggcucaauaaguccaagccuuacuacacaggagagcacgccaaagcgaucggcaacugcccgaucugggugaagacaccccugaaacuggccaaugggaccaaguauagaccucccgcuaaacuccugaaggaacggggauuuuucggcgccauugcuggguuucuugagggcggaugggaaggcaugaucgccggguggcauggauacacgucucacggcgcccacggggucgcuguggcggccgaucucaagagcacccaggaggcuauuaacaaaaucacaaagaaucugaacucccugagcgaacuugagguuaaaaaucugcagcgccucucuggagccauggacgagcugcauaacgaaauucuggagcucgaugaaaagguggacgaccugagagccgauaccaucuccagccaaaucgagcuugcuguccugcucucuaaugaaggcauuaucaacagcgaggacgagcaucugcuugcccuggaacggaaacucaagaagaugcuggggccuuccgcgguggagauuggcaauggauguuucgaaacaaaacacaagugcaaccagaccugccuggaucgcaucgcugccggcacguuugacgccggggaguucucucuccccaccuuugauagccugaauauuacagcugccucccuuaacgacgauggacuggacaaucacaccauccuccuguauuacagcacagcugccucuucccuggcggucacccuuaugauugccaucuucgugguuuauauggugagcagagauaacgucucuuguuccaucugccucuga

SEQ ID NO: 210823 - RNA, 1758 nt, Artificial Sequence; identical to SEQ ID NO: 210822
  derived and/or modified sequence opt5 from hemagglutinin__InfluenzaB__AGX84876

SEQ ID NO: 210824 - RNA, 1758 nt, Artificial Sequence; identical to SEQ ID NO: 210822
  derived and/or modified sequence opt5 from hemagglutinin__InfluenzaB__AGX84887

SEQ ID NO: 210825 - RNA, 1758 nt, Artificial Sequence; identical to SEQ ID NO: 209707
  derived and/or modified sequence opt5 from hemagglutinin__InfluenzaB__AGX84898

SEQ ID NO: 210826 - RNA, 1758 nt, Artificial Sequence
  derived and/or modified sequence opt5 from hemagglutinin__InfluenzaB__AGX84920
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccggggucagcauccuucacgaggugagacccguuacauccggauguuuuccuaucaugcaugaucggaccaaaauucgccaacugccgaaucuccugagaggcuacgaacacauccggcugucuacgcauaacgugauuaaugccgagaacgcucccggcgggccuuauaagaucggaacaagcggcuccugccccaaugucaccaacgggaauggauucuuugccacaauggcuugggccgugccuaaaaacgacaagaauaaaaccgcgaccaacccccucacaauugaagugccguacaucuguacggagggcgaggaucagauuaccgucuggggguuccacagcgacaaugaaacacagauggccaagcuguauggagauucuaagccucagaaauuuaccuccagcgcuaacggcguuacaacccacuacgugucucaaaucggcggguuccccaaccagacggaggacggaggccuuccucaguccgggcgcaucguggucgauuauauggugcaaaagagcggaaaaacaggcaccauuaccuaccagagagggauccugcucccccagaagguuuggugcgccucuggacgguccaaagugauuaagggcagccugccccuuaucggcgaagcugacugucugcaugagaaauaugggggacucaauaaguccaagccuuacuacacaggcgagcacgccaaagcgauugggaacugcccgaucugggucaagacaccccugaaacuggccaauggaaccaaguaucgcccucccgcuaaacuccugaaggaaagaggcuuuuucggggccaucgcuggcuuucuugagggaggcugggaagggaugauugccggauggcauggcuacacgucucacggggcccacggaguggcuguugcggccgaucucaagagcacccaggaggcuaucaacaaaauuacaaagaaucugaacucccugagcgaacuugaggugaaaaaucugcagcggcucucuggcgccauggacgagcugcauaacgaaauccuggagcucgaugaaaaggucgacgaccugcgcgccgauaccauuuccagccaaaucgagcuugcugugcugcucucuaaugaagggaucauuaacagcgaggacgagcaucugcuugcccuggaaagaaaacucaagaagaugcugggcccuuccgcggucgagaucggaaauggcuguuucgaaacaaaacacaagugcaaccagaccugccuggaucggauugcugccgggacguuugacgccggagaguucucucuccccaccuuugauagccugaauaucacagcugccucccuuaacgacgauggccuggacaaucacaccauucuccuguauuacagcacagcugccucuucccuggcggugacccuuaugaucgccauuuucguuguguauauggucagccgcgauaacgugucuuguuccaucugccucuga

SEQ ID NO: 210827 - RNA, 1758 nt, Artificial Sequence
  derived and/or modified sequence opt5 from hemagglutinin__InfluenzaB__AGZ59821
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugcuuuaacuguacagaucucgacguggcucugggacgcccuaagugcaccggcaauauucccucugccaaagucagcauccuucacgaagugagaccuguuacauccggguguuuccccaucaugcaugaucggaccaaggugcgccaacugccuaaccuccugagaggauacgagcacauucggcugucuacgcauaaugucaucaacgccgaaaaagcuccgggcggccccuauaagauugggacaagcggauccugcccuaaugugaccaacggcaauggguuuuucgccacaauggcuugggccgugcccaaaaacgacaauaacaagaccgcgaccaauagccucacaaucgaggucccuuacauuuguacggaaggagaggaucagaucaccguuuggggcuuucacucugacaacgagacacagauggccaagcuguauggggauuccaaaccccagaaguucaccagcucugcuaacggagugacaacccacuacgugucccaaauuggcggcuuuccgaaucagacggaagacgggggacuuccucagagcggccgcaucgucguggauuauaugguucagaaaucugggaagacaggaaccaucaccuaccaaagaggcauucugcucccccagaaaguguggugcgccuccgggcggagcaaggucaucaaaggaucccugccucuuauuggcgaggcugacugucugcaugaaaaguauggcgggcucaacaagucuaaacccuacuacacaggagagcacgccaaggcgaucggcaauugccccauuugggugaaaaccccucugaagcuggccaacgggacaaaauaucgcccgcccgcuaagcuccugaaggagagaggauucuuuggcgccaucgcuggguuccuugaaggcggaugggagggcaugaucgccggguggcauggauacacgagccacggcgcccacgggguugcuguggcggccgaucugaaauccacccaggaagcuauuaauaagaucaccaaaaaccucaauagccugucugagcuugaagucaagaaccugcagcggcucuccggagccauggacgagcugcauaaugagauucuggaacucgaugagaaaguggacgaccugcgcgccgauacaaucagcucucaaauugaacuugcuguccugcucagcaacgagggcaucaucaauuccgaagacgagcaucugcuugcccuggagagaaagcucaagaaaaugcuggggccuucugcgguggaaauuggcaacggauguuuugagacaaagcacaaaugcaaucagaccugccuggaucggaucgcugccggcacguucgacgccggggaauuuagccuccccaccuucgauucccugaacauuacagcugccagccuuaaugacgauggacuggacaaccacaccauccuccuguauuacucuacagcugccuccagccuggcgguuacccuuaugauugccaucuucguggucuauauggugucucgcgauaacguuuccuguagcauuugccucuga

SEQ ID NO: 210828 - RNA, 1758 nt, Artificial Sequence
  derived and/or modified sequence opt5 from hemagglutinin__InfluenzaB__AGZ59832
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaaugucaccaacggcaauggguucuuugccacaauggcuugggccgugcccaaaaacgacaauaacaagaccgcgaccaauagccugacaauugaggugccuuacaucuguacggaaggagaggaucagauuaccgucuggggcuuccacucugacaacgagacacagauggccaaacuuuauggggauuccaagccccagaaguuuaccagcucugcuaacggaguuacaacccacuacgugucccaaaucggcggcuucccgaaucagacggaagacgggggacugccucagagcggccgcaucguggucgauuauauggugcagaaaucugggaagacaggaaccauuaccuaccaaagaggcauccuccugccccagaaaguuuggugcgccuccggaaagagcaaagugauuaaggggucccuuccucugaucggcgaggcugacugucuccaugaaaaguauggcgggcugaacaaaucuaagcccuacuacacaggagagcacgccaaagcgauuggcaauugccccaucugggucaagaccccucugaaacucgccaacgggacaaaguaucggccgcccgcuaagcugcuuaaagagcgcggauuuuucggcgccaucgcuggguuucuggaaggcggaugggagggcaugauugccggguggcauggauacacgagccacggcgcccacgggguggcuguugcggccgaucucaaguccacccaggaagcuaucaauaaaauuacaaagaaccugaauagccuuucugagcuggaagugaaaaaccuccagagacuguccggagccauggacgagcugcauaaugagauccucgaacuggaugagaaggucgacgaccuucgggccgauaccauuagcucucaaaucgaacuggcugugcuccugagcaacgagggcaucauuaauuccgaagacgagcaccuucuggcccucgagcgcaagcugaaaaagaugcuggggccuucugcggucgaaaucggcaacggauguuucgagacaaaacauaagugcaaucagaccugccucgauagaauugcugccggcacguuugacgccggggaguucagccugcccaccuuugauucccuuaacaucacagcugccagccugaaugaagacggacucgauaaccacaccauucugcuguauuacucuacagcugccuccagccuugcggugacccucaugaucgccauuuucguuguguauauggucucucgggacaacguguccuguagcaucugccuguga

SEQ ID NO: 210829 - RNA, 1758 nt, Artificial Sequence
  derived and/or modified sequence opt5 from hemagglutinin__InfluenzaB__AGZ59843
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucaucguuuauauggugucuagagauaaugucuccuguagcaucugccuguga

SEQ ID NO: 210830 - RNA, 1758 nt, Artificial Sequence; identical to SEQ ID NO: 210176
  derived and/or modified sequence opt5 from hemagglutinin__InfluenzaB__AGZ59854

SEQ ID NO: 210831 - RNA, 1758 nt, Artificial Sequence; identical to SEQ ID NO: 209538
  derived and/or modified sequence opt5 from hemagglutinin__InfluenzaB__AGZ59865

SEQ ID NO: 210832 - RNA, 1758 nt, Artificial Sequence
  derived and/or modified sequence opt5 from hemagglutinin__InfluenzaB__AGZ59876
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaaaaacaagaccgcgaccaauagccugacaauugaagugccuuacaucuguacggagggagaggaucagauuaccgucuggggcuuccacucugacaacgaaacacagauggccaaacuuuauggggauuccaagccccagaaguuuaccagcucugcuaacggaguuacaacccacuacgugucccaaaucggcggcuucccgaaucagacggaggacgggggacugccucagagcggcagaaucguggucgauuauauggugcagaaaucugggaagacaggaaccauuaccuaccaacggggcauccuccugccccagaaaguuuggugcacauccgggcgcagcaaggugauuaaaggaucccuuccucugaucggcgaagccgacugucuccaugagaaguauggcgggcugaacaaaucuaagcccuacuacaccggagagcacgcuaaggccauuggcaauugccccaucugggucaaaacaccucugaagcucgcgaacgggacgaaauauagaccgcccgccaagcugcuuaaagaacggggauuuuucggcgcuaucgccggguuucuggagggcggaugggaaggcaugauugcuggguggcauggauacaccagccacggcgcccacgggguggccguugcugcggaucucaaguccacacaggaggccaucaauaagauuaccaaaaaccugaauagccuuucugaacuggaggugaagaaccuccagcgccuguccggagcuauggacgagcugcauaaugaaauccucgagcuggaugaaaaagucgacgaccuuagagccgauacaauuagcucucaaaucgagcuggccgugcuccugagcaacgaaggcaucauuaauuccgaggacgagcaccuucuggcucucgaacggaagcugaaaaagaugcuggggccuucugccgucgagaucggcaacggauguuucgaaaccaagcauaaaugcaaucagacgugccucgaucgcauugcggcuggcaccuuugacgccggggaguucagccugcccacauuugauucccuuaacaucaccgccgcuagccugaaugacgauggacucgacaaccacacaauucugcuguauuacucuaccgccgcuuccagccuugccgugacgcucaugaucgcgauuuucguuguguauauggucucuagagauaacguguccuguagcaucugccuguga

SEQ ID NO: 210833 - RNA, 1755 nt, Artificial Sequence; identical to SEQ ID NO: 209591
  derived and/or modified sequence opt5 from hemagglutinin__InfluenzaB__AGZ59887

SEQ ID NO: 210834 - RNA, 1758 nt, Artificial Sequence; identical to SEQ ID NO: 210013
  derived and/or modified sequence opt5 from hemagglutinin__InfluenzaB__AGZ59898

SEQ ID NO: 210835 - RNA, 1758 nt, Artificial Sequence; identical to SEQ ID NO: 210379
  derived and/or modified sequence opt5 from hemagglutinin__InfluenzaB__AGZ59909

SEQ ID NO: 210836 - RNA, 1758 nt, Artificial Sequence; identical to SEQ ID NO: 210013
  derived and/or modified sequence opt5 from hemagglutinin__InfluenzaB__AGZ59920

SEQ ID NO: 210837 - RNA, 1758 nt, Artificial Sequence; identical to SEQ ID NO: 210013
  derived and/or modified sequence opt5 from hemagglutinin__InfluenzaB__AGZ59931

SEQ ID NO: 210838 - RNA, 1758 nt, Artificial Sequence; identical to SEQ ID NO: 210013
  derived and/or modified sequence opt5 from hemagglutinin__InfluenzaB__AGZ59942

SEQ ID NO: 210839 - RNA, 1758 nt, Artificial Sequence; identical to SEQ ID NO: 210013
  derived and/or modified sequence opt5 from hemagglutinin__InfluenzaB__AGZ59953

SEQ ID NO: 210840 - RNA, 1758 nt, Artificial Sequence
  derived and/or modified sequence opt5 from hemagglutinin__InfluenzaB__AGZ59965
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagagugguggucgauuauaugaugcaaaagagcgggaaaacaggaaccauuaccuaccagcggggcauccuccugccucagaagguguggugcgccucugggcgcuccaaaguuauuaagggaagccuuccccugaucggcgaagcugacugucuccaugagaaauauggcgggcugaauaaguccaagcccuacuacacaggagagcacgccaaagcgauuggcaacugcccuaucugggugaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacggggucgcuguggcggccgaucucaagagcacccaggaggcuaucaacaaaauuacaaagaaucugaacucccuuagcgaacuggagguuaaaaaucuccagcgccugucuggagccauggacgagcugcauaacgaaauccucgagcuggaugaaaagguggacgaccuuagagccgauaccauuuccagccaaaucgagcuggcuguccuccugucuaaugaaggcaucauuaacagcgaggacgagcaccuucuggcccucgaacggaaacugaagaagaugcuggggcccuccgcgguggagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggucacccucaugaucgccauuuucgugguuuauauggugagcagagauaacgucucuuguuccaucugccuguga

SEQ ID NO: 210841 - RNA, 1758 nt, Artificial Sequence; identical to SEQ ID NO: 210013
  derived and/or modified sequence opt5 from hemagglutinin__InfluenzaB__AGZ59976

SEQ ID NO: 210842 - RNA, 1758 nt, Artificial Sequence; identical to SEQ ID NO: 210013
  derived and/or modified sequence opt5 from hemagglutinin__InfluenzaB__AGZ59987

SEQ ID NO: 210843 - RNA, 1758 nt, Artificial Sequence; identical to SEQ ID NO: 210013
  derived and/or modified sequence opt5 from hemagglutinin__InfluenzaB__AGZ59999

SEQ ID NO: 210844 - RNA, 1758 nt, Artificial Sequence; identical to SEQ ID NO: 209632
  derived and/or modified sequence opt5 from hemagglutinin__InfluenzaB__AGZ60010

SEQ ID NO: 210845 - RNA, 1758 nt, Artificial Sequence; identical to SEQ ID NO: 209632
  derived and/or modified sequence opt5 from hemagglutinin__InfluenzaB__AGZ60021

SEQ ID NO: 210846 - RNA, 1758 nt, Artificial Sequence; identical to SEQ ID NO: 209632
  derived and/or modified sequence opt5 from hemagglutinin__InfluenzaB__AGZ60033

SEQ ID NO: 210847 - RNA, 1755 nt, Artificial Sequence
  derived and/or modified sequence opt5 from hemagglutinin__InfluenzaB__AGZ60044
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaacgccccgggcggccccuacagacuggggaccagcggauccugcccuaaugcuacaagcaagucuggcuucuuugccaccauggcgugggccguccccaaagacaacaauaagaacgcuaccaauccucuuacaguggaggugcccuaugucuguacggaaggggaggaucagauuaccguuuggggauuccauuccgacaacaaaacacagaugaagaaucuguacggcgauagcaacccgcaaaaauuuaccucuuccgccaacggggugacaacccacuaugugagccagaucggaggcuucccugcucagacggaggacggcgggcucccccagucuggacggauugucguggauuacaugguucaaaagccucgcaagacaggcaccaucguguaucagagagggguccugcuuccccagaaaguguggugcgccuccggacggagcaagguuauuaaaggcucccugccccucaucggggaagcggacugucugcaugagaaguacggaggccugaauaaaucuaagccuuacuauaccggcgaacacgccaaagcuaucgggaacugcccgauuugggugaagacaccccucaagcuggccaauggaaccaaauaccgcccucccgcuaagcugcugaaagagagaggcuuuuucggggccaucgccggauuucucgagggcgggugggaaggcaugauugcuggauggcacggcuauacaagccauggggcgcacggagucgccguggcugccgaucugaaguccacgcaggaggccaucaacaaaauuaccaagaaucuuaacagccugucugaacucgaggucaagaaucugcaacggcuguccggcgcuauggacgaacuccauaacgagauccuggagcuugacgaaaaaguggaugaccugcgcgccgauacaaucagcucucagauugagcucgcgguucugcuuagcaaugaagggaucauuaacuccgaggacgaacaccuucucgcucuggagagaaagcugaaaaagaugcucggaccuucugccguggauaucggcaauggguguuucgagaccaaacacaagugcaaccagacaugccuggaccggauugccgcuggcaccuuuaaugccggagaguucagccuucccacguuugauucccugaacaucaccgcugccagccucaaugacgauggccuggacaaccauacaauccugcuuuacuauucuaccgcggccuccagccucgcugucacacugaugcuggccauuuucaucguguacaugguuucuagagauaacguguccuguagcauuugccucuga

SEQ ID NO: 210848 - RNA, 1755 nt, Artificial Sequence; identical to SEQ ID NO: 210050
  derived and/or modified sequence opt5 from hemagglutinin__InfluenzaB__AGZ60055

SEQ ID NO: 210849 - RNA, 1755 nt, Artificial Sequence
  derived and/or modified sequence opt5 from hemagglutinin__InfluenzaB__AGZ60066
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcggacccgcgggaagcugugucccgauugccucaacuguacagaccuggauguggcucuuggaagaccuaugugcgucggcaccacacccucugccaaagccagcauucugcacgaagugcggccuguuaccuccggguguuuucccaucaugcaugaccgcacgaagaucagacaacucccuaaucugcugcggggauacgagaacauucgccucucuacacagaaugugaucgaugcugaaaaggcccugggcggcccguauagacuugggaccagcggauccugccccaacgcuacaagcaaaucuggcuucuuugccaccauggcgugggccgucccuaaggacaauaacaaaaaugcuaccaacccccugacaguggaggugccuuacauuuguacggaaggggaggaucagaucaccgucuggggauuccacuccgacaauaagacacagaugaaaaaccucuauggcgauagcaauccccaaaaguuuaccucuuccgccaacgggguuacaacccauuacgugagccagauuggaggcuucccggaccagacggaggauggcgggcugccucagucuggacggaucguggucgacuauauggugcaaaagcccggcaaaacagggaccauuguuuaccagcgcggagugcuucugccucagaaggucuggugcgcuuccggcagaagcaaagugaucaaggggucccucccccugaucggagaagccgauugucugcacgagaaauauggcggccucaacaagucuaaacccuacuacaccggggaacacgcgaaggccauuggaaauugcccuaucuggguuaagacaccgcugaaacuugcuaacggcaccaaguaucggcccccugccaaacugcucaaggagcgcggguuuuucggagcuauugccggcuuucuggaagggggcugggaaggaaugaucgccggcuggcauggguacacaagccacggagcucauggcguggcggucgccgcugaccuuaaauccacgcaggaggccauuaauaagaucaccaagaaccugaauagccucucugaacuggaggugaaaaaccugcaaagacucuccggggccauggacgaacugcacaaugagauccuugagcuggaugaaaaggucgacgaucuccgggcugacacaauuagcucucagaucgagcuggccgugcuucugagcaacgaaggaauuaucaauuccgaggaugaacaccuccuggcgcuggagcgcaaacucaagaaaaugcugggccccucugcuguugacauugggaacggcuguuucgagaccaagcauaagugcaaucagacaugccuugauagaaucgccgccggaaccuuuaacgcuggcgaguucagccugccuacguuugacucccucaauaucaccgccgcuagccugaacgaugacgggcuggauaaucacacaauucuucucuauuacucuaccgccgcguccagccuggccgugacacugaugcucgcuaucuucauugucuauauggugucucgggacaacguuuccuguagcaucugccuguga

SEQ ID NO: 210850 - RNA, 1755 nt, Artificial Sequence
  derived and/or modified sequence opt5 from hemagglutinin__InfluenzaB__AGZ60077
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaucuccuaugugcgucggcaccacacccagcgccaaagccuccauucugcaugaagugagaccuguuaccucuggguguuuucccaucaugcacgaccggacgaagauccgccaacucgcuaaucugcugagaggauaugagaacauucggcucagcacacagaaugugaucgaugccgaaaaggcuccuggcggcccguaccgccuggggaccuccggaagcugccccaacgccacaucuaaauccggcuucuuugcgaccauggccugggcugucccuaaggacaauaacaaaaaugccaccaacccccuuacaguggaggugccuuauauuuguacggaaggggaggaucagaucaccgucuggggauuccauagcgacaauaagacacagaugaaaaaccuguacggcgauucuaauccccaaaaguuuaccuccagcgcuaacgggguuacaacccacuaugugucucagauuggaggcuucccggaccagacggaggauggcgggcucccucaguccggaagaaucguggucgacuacaugaugcaaaagagcggcaaaacagggaccauuguguaucagcggggaguucugcuuccccagaagguguggugcgccuccggccgcucuaaagucaucaaggggagccugccucucaucggagaagcggauugucugcaugagaaauacggcggccugaacaaguccaaacccuacuauaccggggaacacgccaaggcuauuggaaauugccccaucugggugaagacaccucucaaacuggccaacggcaccaaguacagaccgcccgcuaaacuucugaaggagcggggguuuuucggagccauugccggcuuucucgaagggggcugggaaggaaugaucgcuggcuggcacggguauacaagccauggagcgcacggcguugccguggcugccgaccugaaaucuacgcaggaggccauuaauaagaucaccaagaaccuuaauucccugagcgaacucgaggucaaaaaccugcaacgccugucuggggcuauggacgaacuccauagcgagauccuggagcuugaugaaaagguggacgaucugagagccgacacaauuuccucucagaucgagcucgcgguccugcuuagcaaugaaggaauuaucaacuccgaggaugaacaucugcucgcucuggagcggaaacugaagaaaaugcucggcccuagcgccguggacauugggaauggcuguuucgagaccaagcacaagugcaaccagacaugccuggaucgcaucgccgcuggaaccuuuaaugccggcgaguucucucuucccacguuugacucccugaacaucaccgcugccagccucaaugaugacgggcuggauaaccacacaauucugcuuuacuauucuaccgcggccuccagccucgcuguuacacugaugcuggccaucuucauuguguacauggucuccagagacaaugugucuuguagcaucugccucuga

SEQ ID NO: 210851 - RNA, 1755 nt, Artificial Sequence; identical to SEQ ID NO: 209755
  derived and/or modified sequence opt5 from hemagglutinin__InfluenzaB__AGZ60088

SEQ ID NO: 210852 - RNA, 1755 nt, Artificial Sequence; identical to SEQ ID NO: 209450
  derived and/or modified sequence opt5 from hemagglutinin__InfluenzaB__AGZ60099

SEQ ID NO: 210853 - RNA, 1755 nt, Artificial Sequence
  derived and/or modified sequence opt5 from hemagglutinin__InfluenzaB__AGZ60131
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuaucaccuccggguguuuucccaucaugcacgaccgcacgaagauuagacaacucccuaaucugcugcggggauaugagaacauccgccucucuacacagaauguuauugaugcugaaaaggccccgggcggccccuacagacuggggaccagcggauccugcccuaacgcuacaagcaaaucuggcuucuuugccaccauggcgugggccgugcccaaggacaauaacaaaaaugcuaccaacccucuuacagucgaggugcccuauaucuguacggaaggggaggaucagauuaccguguggggauuccauuccgacaauaagacacagaugaaaaaccuguacggcgauagcaauccgcaaaaguuuaccucuuccgccaacggggucacaacccacuauguuagccagaucggaucuuucccugaccagacggaggauggcggccucccccaguccgggcggauugugguggacuacaugaugcaaaagccuggaaaaacaggcaccaucgucuaucagcgcggggugcugcuuccccagaagguuuggugcgcuagcggaagauccaaagugaucaagggcucucugccccucauuggggaagccgauugucugcaugagaaauacggaggccugaacaagagcaaaccuuacuauaccggcgaacacgcgaaggccaucgggaauugcccgauuugggucaagacaccccucaaacuggcuaacggaaccaaguaccggccucccgccaaacuucugaaggagcgcggcuuuuucggggcuaucgccggauuucucgagggcgggugggaaggcaugauugccggauggcacggcuauacaucccauggggcucacggaguggcgguugccgcugaccugaaaagcacgcaggaggccaucaauaagaucaccaagaaccuuaauucucuguccgaacucgaggugaaaaaccugcaaagacugagcggcgccauggacgaacuccauaaugagauucuggagcuugaugaaaaggucgacgaucugcgggcugacacaaucucuagccagauugagcucgccgugcugcuuuccaacgaagggaucauuaauucugaggaugaacaucugcucgcgcuggagcgcaaacugaagaaaaugcucggaccuagcgcugucgagaucggcaacggguguuucgaaaccaagcacaagugcaaucagacaugccuggacagaaucgccgccggcaccuuuaacgcuggagaguucucccuucccacguuugauagccugaauauuaccgccgcuucucucaacgacgauggccuggacaaucacacaauccugcuuuacuauuccaccgccgcgagcucucucgccgugacacugaugcuggcuauuuucaucguuuacauggugucccgggauaacgucagcuguuccauuugccucuga

SEQ ID NO: 210854 - RNA, 1755 nt, Artificial Sequence; identical to SEQ ID NO: 209755
  derived and/or modified sequence opt5 from hemagglutinin__InfluenzaB__AGZ60142

SEQ ID NO: 210855 - RNA, 1755 nt, Artificial Sequence; identical to SEQ ID NO: 209755
  derived and/or modified sequence opt5 from hemagglutinin__InfluenzaB__AGZ60160

SEQ ID NO: 210856 - RNA, 1755 nt, Artificial Sequence; identical to SEQ ID NO: 209844
  derived and/or modified sequence opt5 from hemagglutinin__InfluenzaB__AGZ60172

SEQ ID NO: 210857 - RNA, 1755 nt, Artificial Sequence; identical to SEQ ID NO: 209844
  derived and/or modified sequence opt5 from hemagglutinin__InfluenzaB__AGZ60183

SEQ ID NO: 210858 - RNA, 1755 nt, Artificial Sequence
  derived and/or modified sequence opt5 from hemagglutinin__InfluenzaB__AGZ60194
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagacaggaaaaaccggcaccaucguguaccagcgcgggguucugcuuccucagaagguguggugcgcuucuggaagauccaaagucaucaagggcagccugccccucauuggggaagccgacugucugcaugagaaauacggaggccugaacaaguccaaacccuauuacacaggcgaacacgcgaaggccaucgggaacugcccuauuugggugaagaccccgcucaaacuggcuaauggaacaaaguaucggcccccugccaaacuucugaaggagcgcggcuuuuucggggcuaucgccggauuucucgagggcgggugggaaggcaugauugccggauggcacggcuacacgucucauggggcucacggaguugcgguggccgcugaccugaaaagcacccaggaggccaucaacaagaucacaaagaaucuuaacucccugagcgaacucgaggucaaaaaucugcaaagacugucuggcgccauggaugaacuccauaacgagauucuggagcuugacgaaaagguggaugaccugcgggcugauaccaucuccagccagauugagcucgccguccugcuuucuaaugaagggaucauuaacagcgaggacgaacaucugcucgcgcuggagcgcaaacugaagaaaaugcucggacccuccgcuguggauaucggcaauggguguuucgagacaaagcacaagugcaaccagaccugccuggacagaaucgccgccggcacguuuaaugcuggagaguucucucuuccuaccuuugauagccugaacauuacagccgcuucccucaaugacgauggccuggacaaccacaccauccugcuuuauuacagcacagccgcgucuucccucgccguuacccugaugcuggcuauuuucaucguguauauggucagccgggacaaugugucuuguuccauuugccucuga

SEQ ID NO: 210859 - RNA, 1755 nt, Artificial Sequence
  derived and/or modified sequence opt5 from hemagglutinin__InfluenzaB__AGZ60206
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgauuaaguccuacuucgcgaaucuuaaaggcacccggacgcgcgggaagcugugucccgauugccucaacuguaccgaccuggauguggcucuuggaagaccuaugugcgucggcacaacccccucugccaaagccagcauccugcaugaagugcggccuguuacauccggguguuuucccaucaugcacgaccgcaccaagauuagacaacucccuaaucugcugcggggauaugagaacauccgccucucuacgcagaaugugauugaugcugaaaaggccccgggcggccccuacagacuggggacaagcggauccugcccuaacgcuaccagcaaaaucggcuucuuugccacaauggcgugggccguccccaaggacaauuauaaaaacgcuaccaauccucuuaccguggaggugcccuacauuuguacagaaggggaggaucagaucacggucuggggauuccauucugacaacaagacccagaugaaaaaucuguauggcgauuccaacccgcaaaaguuuacaagcucugccaaugggguuaccacacacuacgugucccagauuggagacuucccugaucagaccgaggacggcggccucccccagagcgggcggaucguggucgauuauaugaugcaaaagccuggaaaaacgggcacaaucguguaccagcgcgggguucugcuuccccagaagguguggugcgcuucuggaagauccaaagucauuaagggcagccugccccucaucggggaagccgacugucugcaugagaaauacggaggccugaacaaguccaaaccuuauuacaccggcgaacacgcgaaggccauugggaacugcccgaucugggugaagacaccccucaaacuggcuaauggaaccaaguaucggccucccgccaaacuucugaaggagcgcggcuuuuucggggcuauugccggauuucucgagggcgggugggaaggcaugaucgccggauggcacggcuacaccucucauggggcucacggaguugcgguggccgcugaccugaaaagcacacaggaggccaucaacaagauuacgaagaaucuuaacucccugagcgaacucgaggucaaaaaucugcaaagacugucuggcgccauggaugaacuccauaacgagauccuggagcuugacgaaaagguggaugaccugcgggcugauaccauuuccagccagaucgagcucgccguccugcuuucuaaugaagggauuaucaacagcgaggacgaacaucugcucgcgcuggagcgcaaacugaagaaaaugcucggaccuuccgcuguggauaucggcaauggguguuucgagacaaagcacaagugcaaccagaccugccuggacagaauugccgccggcacauuuaaugcuggagaguucucucuucccaccuuugauagccugaacaucacggccgcuucccucaaugacgauggccuggacaaccacaccauucugcuuuauuacagcacagccgcgucuucccucgccguuacccugaugcuggcuaucuucauuguguauauggucagccgggacaaugugucuuguuccaucugccucuga

SEQ ID NO: 210860 - RNA, 1755 nt, Artificial Sequence; identical to SEQ ID NO: 210789
  derived and/or modified sequence opt5 from hemagglutinin__InfluenzaB__AGZ60217

SEQ ID NO: 210861 - RNA, 1755 nt, Artificial Sequence
  derived and/or modified sequence opt5 from hemagglutinin__InfluenzaB__AGZ60268
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcccggcaaaacagggaccauuguguaucagcgcggaguucugcuuccucagaagguguggugcgccuccggcagaagcaaagucaucaaggggucccugccccucaucggagaagcggauugucugcaugagaaauacggcggccugaacaagucuaaacccuacuauaccggggaacacgccaaggcuauuggaaauugcccuaucugggugaagacaccgcucaaacuggccaacggcaccaaguaccggcccccugcuaaacuucugaaggagcgcggguuuuucggagccauugccggcuuucucgaagggggcugggaaggaaugaucgcuggcuggcacggguauacaagccauggagcgcacggcguugccguggcugccgaccugaaauccacgcaggaggccauuaauaagaucaccaagaaccuuaauagccugucugaacucgaggucaaaaaccugcaaagacuguccggggcuauggacgaacuccauaaugagauccuggagcuugaugaaaagguggacgaucugcgggccgacacaauuagcucucagaucgagcucgcgguccugcuuagcaacgaaggaauuaucaauuccgaggaugaacaucugcucgcucuggagcgcaaacugaagaaaaugcucggccccucugccauugacaucgggaacggcuguuucgagaccaagcacaagugcaaucagacaugccuggauagaaucgccgcuggaaccuuuaacgccggcgaguucagccuuccuacguuugacucccugaauauuaccgcugccagccucaacgaugacgggcuggauaaucacacaauccugcuuuacuauucuaccgcggccuccagccucgcugugacacugaugcuggccauuuucaucguuuacauggugucucgggacaacgucuccuguagcauuugccucuga

SEQ ID NO: 210862 - RNA, 1755 nt, Artificial Sequence; identical to SEQ ID NO: 209878
  derived and/or modified sequence opt5 from hemagglutinin__InfluenzaB__AHE37993

SEQ ID NO: 210863 - RNA, 1755 nt, Artificial Sequence; identical to SEQ ID NO: 209923
  derived and/or modified sequence opt5 from hemagglutinin__InfluenzaB__AHE37994

SEQ ID NO: 210864 - RNA, 1755 nt, Artificial Sequence; identical to SEQ ID NO: 209878
  derived and/or modified sequence opt5 from hemagglutinin__InfluenzaB__AHE37995

SEQ ID NO: 210865 - RNA, 1755 nt, Artificial Sequence; identical to SEQ ID NO: 209878
  derived and/or modified sequence opt5 from hemagglutinin__InfluenzaB__AHE37996

SEQ ID NO: 210866 - RNA, 1755 nt, Artificial Sequence; identical to SEQ ID NO: 209923
  derived and/or modified sequence opt5 from hemagglutinin__InfluenzaB__AHE37997

SEQ ID NO: 210867 - RNA, 1755 nt, Artificial Sequence; identical to SEQ ID NO: 209923
  derived and/or modified sequence opt5 from hemagglutinin__InfluenzaB__AHE37998

SEQ ID NO: 210868 - RNA, 1755 nt, Artificial Sequence; identical to SEQ ID NO: 209923
  derived and/or modified sequence opt5 from hemagglutinin__InfluenzaB__AHE37999

SEQ ID NO: 210869 - RNA, 1755 nt, Artificial Sequence; identical to SEQ ID NO: 209878
  derived and/or modified sequence opt5 from hemagglutinin__InfluenzaB__AHE38000

SEQ ID NO: 210870 - RNA, 1755 nt, Artificial Sequence; identical to SEQ ID NO: 209878
  derived and/or modified sequence opt5 from hemagglutinin__InfluenzaB__AHE38001

SEQ ID NO: 210871 - RNA, 1755 nt, Artificial Sequence
  derived and/or modified sequence opt5 from hemagglutinin__InfluenzaB__AHE38002
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccaaaaaggcuccuggcggcccguaccgccuggggaccagcggauccugccccaacgccacaagcaaaucuggcuucuuugcgaccauggccugggcugucccuaaggacaauaacaaaaaugccaccaacccccuuacaguggaagugccuuauauuugugcugagggggaagaucagaucacggucuggggauuccauuccgacaauaagacccagaugaagaaccuguacggcgauagcaauccccaaaaauuuacaucuuccgccaacgggguuaccacacacuaugugagccagauuggaggcuucccggaccagaccgaggauggcgggcucccucagucuggaagaaucguggucgacuacaugaugcaaaagcccggcaaaacggggacaauuguguaucagcggggaguucugcuuccucagaagguguggugcgcguccggccgcagcaaagucaucaaggggucccugccccucaucggagaggccgauugucugcaugaaaaauacggcggccugaacaagucuaagcccuacuauaccggggagcacgcuaaagccauuggaaauugcccuaucugggugaagaccccgcucaaacuggcuaacggcacaaaguacagacccccugccaaacuucugaaggaacggggguuuuucggagccauugcuggcuuucucgaagggggcugggagggaaugaucgcgggcuggcacggguauaccagccauggagcccacggcguugcuguggccgccgaccugaaguccacacaggaggcuauuaauaaaaucacgaagaaccuuaauagccugucugagcucgaagucaaaaaccugcaacgccuguccggggccauggacgagcuccauaaugaaauccuggagcuugaugagaagguggacgaucugagagcggacaccauuagcucucagaucgaacucgcuguccugcuuagcaacgagggaauuaucaauuccgaagaugagcaucugcucgcccuggaacggaaacugaagaagaugcucggccccucugccguggacauugggaacggcuguuucgagacaaaacacaagugcaaucagaccugccuggaucgcaucgcugccggaacauuuaacgcuggcgaguucagccuuccuaccuuugacucccugaauaucacggccgcgagccucaacgaugacgggcuggauaaucacaccauucugcuuuacuauucuacagccgcuuccagccucgccguuacccugaugcuggcuaucuucauuguguacauggucucuagagacaacguguccuguagcaucugccucuga

SEQ ID NO: 210872 - RNA, 1755 nt, Artificial Sequence; identical to SEQ ID NO: 209878
  derived and/or modified sequence opt5 from hemagglutinin__InfluenzaB__AHE38003

SEQ ID NO: 210873 - RNA, 1755 nt, Artificial Sequence; identical to SEQ ID NO: 209878
  derived and/or modified sequence opt5 from hemagglutinin__InfluenzaB__AHE38004

SEQ ID NO: 210874 - RNA, 1755 nt, Artificial Sequence; identical to SEQ ID NO: 209878
  derived and/or modified sequence opt5 from hemagglutinin__InfluenzaB__AHE38005

SEQ ID NO: 210875 - RNA, 1755 nt, Artificial Sequence
  derived and/or modified sequence opt5 from hemagglutinin__InfluenzaB__AHE38006
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcgccacccccucugccaaggcuagcauucugcaugaagugagaccuguuacauccggguguuuucccaucaugcacgaccggaccaagauccgccaacucgccaaucugcugagaggauaugagaacauucggcucucuacgcagaaugugaucgaugcugaaaaagccccuggcggcccguaccgccuggggacaagcggauccugccccaacgcgaccagcaagucuggcuucuuugccacaauggcuugggccgucccuaaagacaauaacaagaaugcuaccaacccccuuaccguggaggugccuuauauuugugccgaaggggaggaucagaucacagucuggggauuccauuccgacaauaaaacgcagaugaagaaccuguacggcgauagcaauccccaaaaguuuaccucuuccgcgaacgggguuacaacccacuaugugagccagauuggaggcuucccggaccagacagaggauggcgggcucccucagucuggaagaaucguggucgacuacaugaugcaaaaacccggcaagaccgggacgauuguguaucagcggggaguucugcuuccucagaaaguguggugcgccuccggccgcagcaaggucaucaaagggucccugccccucaucggagaagcugauugucugcaugagaaguacggcggccugaacaaaucuaagcccuacuauacaggggaacacgccaaggcuauuggaaauugcccuaucugggugaaaaccccgcucaagcuggccaacggcaccaaauacagacccccugccaaacuucugaaagagcggggguuuuucggagcuauugcgggcuuucucgaagggggcugggaaggaaugaucgccggcuggcacggguauacaagccauggagcucacggcguugccguggccgcugaccugaaguccacccaggaggccauuaauaagaucacaaagaaccuuaauagccugucugaacucgaggucaagaaccugcaacgccuguccggggcgguggacgaacuccauaaugagauccuggagcuugaugaaaaagucgacgaucugagagcugacacgauuagcucucagaucgagcucgccgugcugcuuagcaacgaaggaauuaucaauuccgaggaugaacaucugcucgcccuggagcggaagcugaaaaagaugcucggccccucugcuguugacauugggaacggcuguuucgagaccaagcacaaaugcaaucagacaugccuggaucgcaucgccgcuggaaccuuuaacgccggcgaguucagccuuccuacauuugacucccugaauaucaccgcggccagccucaacgaugacgggcuggauaaucacacgauucugcuuuacuauucuaccgcugccuccagccucgcugugacacugaugcuggccaucuucauugucuacauggugucuagagacaacguuuccuguagcaucugccucuga

SEQ ID NO: 210876 - RNA, 1755 nt, Artificial Sequence; identical to SEQ ID NO: 209878
  derived and/or modified sequence opt5 from hemagglutinin__InfluenzaB__AHE38007

SEQ ID NO: 210877 - RNA, 1755 nt, Artificial Sequence
  derived and/or modified sequence opt5 from hemagglutinin__InfluenzaB__AHE38008
augaaggccaucauugcucugcucaugguggucaccagcaacgccgacagaaucugcacaggcauuacguccucuaauagcccccacguugugaaaaccgcgacacagggggaggugaacgucaccggagugaucccucugacaaccacaccgaccaaguccuacuucgcuaaucuuaaaggcacgaagacccgggggaaacugugucccgauugccucaacuguacagaccuggauguugcccuuggacgcccuaugugcgugggcaccacacccucugccaaggcuagcauucugcaugaagucagaccugugaccuccggguguuuucccaucaugcacgaccggacgaagauccgccaacucgccaaucugcugagaggauaugagaacauucggcucucuacacagaauguuaucgaugcugaaaaagccccuggcggcccguaccgccuggggaccagcggauccugccccaacgcgacaagcaagucuggcuucuuugccaccauggcuugggccgugccuaaagacaauaacaagaaugcuaccaacccccuuacagucgaggugccuuauauuugugccgaaggggaggaucagaucgcgguguggggauuccauuccgacaauaaaacgcagaugaagaaccuguacggcgauagcaauccccaaaaguuuaccucuuccgccaacggggucacaacccacuauguuagccagauuggaggcuucccggaccagacagaggauggcgggcucccucagucuggaagaaucgugguggacuacaugaugcaaaaacccggcaagaccgggacgauugucuaucagcggggagugcugcuuccucagaaaguuuggugcgcuuccggccgcagcaaggugaucaaagggucccugccccucaucggagaagccgauugucugcaugagaaguacggcggccugaacaaaucuaagcccuacuauacaggggaacacgcuaaggccauuggaaauugcccuaucugggucaaaaccccgcucaagcuggccaacggcaccaaauacagacccccugcuaaacuucugaaagagcggggguuuuucggagcgauugccggcuuucucgaagggggcugggaaggaaugaucgcuggcuggcacggguauacaagccauggagcccacggcguggccguugcugccgaccugaaguccacccaggaggcgauuaauaagaucacaaagaaccuuaauagccugucugaacucgaggugaagaaccugcaacgccuguccggggcuauggacgaacuccauaaugagauccuggagcuugaugaaaaagucgacgaucugagagccgacacgauuagcucucagaucgagcucgccgugcugcuuagcaacgaaggaauuaucaauuccgaggaugaacaucugcucgcucuggagcggaagcugaaaaagaugcucggccccucugccgucgacauugggaacggcuguuucgagaccaagcacaaaugcaaucagacaugccuggaucgcaucgcugccggaaccuuuaacgcgggcgaguucagccuuccuacauuugacucccugaauaucaccgccgcuagccucaacgaugacgggcuggauaaucacacgauucugcuuuacuauucuaccgccgcuuccagccucgccgugacacugaugcuggcgaucuucauuguuuacauggugucuagagacaacgucuccuguagcaucugccucuga

SEQ ID NO: 210878 - RNA, 1755 nt, Artificial Sequence; identical to SEQ ID NO: 209923
  derived and/or modified sequence opt5 from hemagglutinin__InfluenzaB__AHE38009

SEQ ID NO: 210879 - RNA, 1755 nt, Artificial Sequence; identical to SEQ ID NO: 209923
  derived and/or modified sequence opt5 from hemagglutinin__InfluenzaB__AHE38010

SEQ ID NO: 210880 - RNA, 1755 nt, Artificial Sequence; identical to SEQ ID NO: 209878
  derived and/or modified sequence opt5 from hemagglutinin__InfluenzaB__AHE38012

SEQ ID NO: 210881 - RNA, 1755 nt, Artificial Sequence
  derived and/or modified sequence opt5 from hemagglutinin__InfluenzaB__AHE38013
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgucuccggccgcagcaaggugaucaaagggucccugccccucaucggagaagcggauugucugcaugagaaguacggcggccugaacaaaucuaagcccuacuauaccggggaacacgccaaggcuauuggaaauugcccuaucuggguuaaaaccccgcucaagcuggccaacggcacaaaauacagacccccugcuaagcugcugaaagagcggggguuuuucggagccauugccggcuuucucgaagggggcugggaaggaaugaucgcuggcuggcacggguauaccagccauggagcgcacggcauggccguggcugccgaccugaaguccacacaggaggccauuaauaagaucacgaaaaaccuuaauagccugucugaacucgaggucaagaaccugcaacgccuguccggggcuauggacgaacuccauaaugagauccuggagcuugaugaaaaaguggacgaucugagagccgacaccauuagcucucagaucgagcucgcgguccugcuuagcaacgaaggaauuaucaauuccgaggaugaacaccuucucgcucuggagcggaagcugaaaaagaugcucggccccucugccguggacauugggaacggcuguuucgagacaaagcacaaaugcaaucagaccugccuggaucgcaucgccgcuggaacauuuaacgccggcgaguucagccuuccuaccuuugacucccugaauaucacggcugccagccucaacgaugacgggcuggauaaucauaccauucugcuuuacuauucuacagcggccuccagccucgcuguuacccugaugcuggccaucuucauuguguacauggucucuagagacaacguguccuguagcaucugccucuga

SEQ ID NO: 210882 - RNA, 1755 nt, Artificial Sequence; identical to SEQ ID NO: 209878
  derived and/or modified sequence opt5 from hemagglutinin__InfluenzaB__AHE38014

SEQ ID NO: 210883 - RNA, 1758 nt, Artificial Sequence; identical to SEQ ID NO: 209669
  derived and/or modified sequence opt5 from hemagglutinin__InfluenzaB__AHE38015

SEQ ID NO: 210884 - RNA, 1758 nt, Artificial Sequence
  derived and/or modified sequence opt5 from hemagglutinin__InfluenzaB__AHE38016
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaauuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggaaauccaaggugauuaaaggaagccuuccccugaucggcgaagcugacugucuccaugagaaguauggcgggcugaauaaguccaaacccuacuacacaggagagcacgccaaggcgauuggcaacugcccuaucugggucaaaaccccgcugaagcucgccaaugggacaaaauauagacccccugcuaagcugcuuaaggaacgcggauuuuucggcgccaucgcuggguuucuggagggcggaugggaaggcaugauugccggguggcauggauacacgucucacggcgcccacgggguggcuguugcggccgaucucaaaagcacccaggaggcuaucaacaagauuacaaagaaucugaacucccuuagcgaacuggaggugaagaaucuccagcggcugucuggagccauggacgagcugcauaacgaaauccucgagcuggaugaaaaagucgacgaccuucgcgccgauaccauuuccagccaaaucgagcuggcugugcuccugucuaaugaaggcaucauuaacagcgaggacgagcaccuucuggcccucgaaagaaagcugaagaaaaugcuggggcccuccgcggucgagaucggcaauggauguuucgaaacaaagcauaaaugcaaccagaccugccucgaucggauugcugccggcacguuugacgccggggaguucucucugccuaccuuugauagccuuaauaucacagcugccucccugaacgacgauggacucgacaaucacauuauccugcuguauuacagcaccgcugccucuucccuugcggugacacucaugauugccaucuucguuguguauauggucagccgcgauaacgugucuuguuccaucugccuguga

SEQ ID NO: 210885 - RNA, 1758 nt, Artificial Sequence; identical to SEQ ID NO: 209988
  derived and/or modified sequence opt5 from hemagglutinin__InfluenzaB__AHE38017

SEQ ID NO: 210886 - RNA, 1758 nt, Artificial Sequence; identical to SEQ ID NO: 209911
  derived and/or modified sequence opt5 from hemagglutinin__InfluenzaB__AHE38018

SEQ ID NO: 210887 - RNA, 1758 nt, Artificial Sequence; identical to SEQ ID NO: 209896
  derived and/or modified sequence opt5 from hemagglutinin__InfluenzaB__AHE38019

SEQ ID NO: 210888 - RNA, 1758 nt, Artificial Sequence
  derived and/or modified sequence opt5 from hemagglutinin__InfluenzaB__AHE38020
augaaggccaucauugugcugcucauggucguuaccagcaacgcugacagaaucugcacaggcauuacguccucuaauagcccccacguggugaaaaccgccacacagggggaggucaacgugaccggaguuaucccucugacaauuaccccgacaaagucccauuucgcgaaucuuaaaggcaccgaaacgcgggggaagcugugucccaaaugccucaacuguaccgaucuggacguggcucuuggacgcccuaagugcacaggcaagauccccucugccagagucagcauccugcacgaggugcggccuguuaccuccggguguuuucccauuaugcaugaucgcacaaaaaucagacaacucccuaaucugcugcggggauacgaacacauucgccucucuacccauaacgugaucaaugccgaggacgcuccgggcggccccuauaagauugggacgagcggauccugcccuaacgucacaaauggcaacggguucuuugccaccauggcuugggccgugcccaaaaaugauaagaacaaaacagcgaccaauccucugaccaucgaagugcccuacauuuguacagagggagaggaccagaucacggucuggggcuuccacagcgauaacgaaacccagauggccaagcuguauggggacucuaagccgcagaaauuuacauccagcgcuaauggaguuaccacacacuacgugucucaaaucggcggcuucccuaaccagaccgaggaugggggacugccccaguccggcagaauuguggucgacuauauggugcaaaagagcgggaaaacgggaacaaucaccuaccagcggggcauucuccugccucagaagguuuggugcgccucugggcgcuccaaagugaucaagggaagccuuccccugauuggcgaagcugauugucuccaugagaaauauggcgggcugaacaaguccaagcccuacuacaccggagagcacgccaaagcgaucggcaauugcccuaucugggucaagacaccgcugaaacucgccaacgggaccaaguauagacccccugcuaaacugcuuaaggaacggggauuuuucggcgccauugcuggguuucuggagggcggaugggaaggcaugaucgccggguggcauggauacacaucucacggcgcccacgggguggcuguugcggccgaccucaagagcacgcaggaggcuauuaauaaaaucaccaagaaccuuaauucccuuagcgaacuggaggugaaaaaccuccagcgccugucuggagccauggaugagcugcauaaugaaauucucgagcuggacgaaaaggucgacgaucuuagagccgacacaaucuccagccaaaucgagcuggcugugcuccugucuaacgaaggcauuaucaauagcgaggaugagcaccuucuggcccucgaacggaaacugaagaagaugcuggggcccuccgcggucgagauuggcaacggauguuucgaaaccaaacauaagugcaaucagacaugccucgaccgcaucgcugccggcaccuuugaugccggggaguucucucugccuacguuugacagccuuaacauuaccgcugccucccugaaugaugacggacucgauaaccacacaauccugcuguauuacagcaccgcugccucuucccuugcggugacacucaugauugccaucuucguuguguauauggucagcagagacaaugugucuuguuccaucugccuguga

SEQ ID NO: 210889 - RNA, 1758 nt, Artificial Sequence
  derived and/or modified sequence opt5 from hemagglutinin__InfluenzaB__AHE38021
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaacccgcagaaguuuaccuccagcgcuaacggaguuacaacccacuacgugucucaaaucggcggcuucccuaaucagacggaggacgggggacugccccaguccggcagaaucguggucgauuauauggugcagaaaagcgggaagacaggaaccauuaccuaccaacggggcauccuccugccucagaaaguuuggugcgccucugggcgcuccaaggugauuaaaggaagccuuccccugaucggcgaagcugacugucuccaugagaaguauggcgggcugaacaaauccaagcccuacuacacaggagagcacgccaaggcgauuggcaauugcccuaucugggucaaaaccccgcugaagcucgccaacgggacaaaauauagacccccugcuaagcugcuuaaagaacggggauuuuucggcgccaucgcuggguuucuggagggcggaugggaaggcaugauugccggguggcauggauacacgucucacggcgcccacgggguggcuguugcggccgaucucaagagcacccaggaggcuaucaauaagauuacaaagaaccuuaauucccugagcgaacuggaggugaagaaccuccagcgccugucuggagccauggacgagcugcauaaugaaauccucgagcuggaugaaaaagucgacgaccuuagagccgauaccauuuccagccaaaucgagcuggcugugcuccugucuaacgaaggcaucauuaauagcgaggacgagcaccuucuggcccucgaacggaagcugaaaaagaugcuggggcccuccgcggucgagaucggcaacggauguuucgaaacaaagcauaaaugcaaucagaccugccucgaucgcauugcugccggcacguuugacgccggggaguucucucugccuaccuuugauagccuuaacaucacagcugccucccugaaugacgauggacucgacaaccacaccauucugcuguauuacagcacagcugccucuucccuugcggugacccucaugaucgccauuuucguuguguauauggucagcagagauaacgugucuuguuccaucugccuguga

SEQ ID NO: 210890 - RNA, 1758 nt, Artificial Sequence; identical to SEQ ID NO: 209911
  derived and/or modified sequence opt5 from hemagglutinin__InfluenzaB__AHE38022

SEQ ID NO: 210891 - RNA, 1752 nt, Artificial Sequence
  derived and/or modified sequence opt5 from hemagglutinin__InfluenzaB__AHL91189
augaaggccaucauugugcugcucauggucgcuaccagcaacgccgacagaaucugcacaggcauuacguccucuaauagcccccacguugugaaaaccgcgacacagggggaggugaacgucaccggagugaucucccugacaaccacaccuaccaagucucauuucgcuaaucuuaaaggcacgaagacccgggggaaacuguguccgaacugccucaauuguacagaucuggacguugcccuuggacgccccauuugcaucggcaccaucccuagcgccaaggcuuccauucugcacgaagugagacccgucacaucuggguguuuuccuaucaugcaugaucggaccaagauucgccaacuccccaaccugcugagaggauacgagcacauccggcucagcacgcauaaugugauuaacgccgaacgcgcuccuggcggcccguauagacuggggacauccggaagcugccccaauguuaccucucgguccggcuucuuugccacaauggcgugggccgugccucgcgacaacaaaaccgcuaccaauccccuuacagucgaggugccuuacaucuguacgaagggggaagaucagauuaccguguggggauuccacagcgacaacaaaacacagaugaagaaucuguauggcgauucuaacccccagaaauuuaccuccagcgccaauggggucacaacccacuacguuucucaaaucggaggcuucccgaaccagacggaggacggcgggcucccucaguccggaagaaucgugguggauuauaugguccagaagcccggcaagacagggaccauuguguaccaacggggaguucugcuuccucagaaaguguggugcgcuagcggccgcuccaaggucaucaaagggucucugccccucauuggagaggccgacugucugcaugaaaaguauggcggccugaacaaaagcaagcccuacuacaccggggagcacgcgaaagccaucggaaauugcccuauuugggugaagacaccgcucaagcuggcuaacggcaccaaauauagacccccugccaagcugcugaaagaacggggguuuuucggagcuaucgccggcuuucucgaagggggcugggagggaaugaucgccggcuggcauggguacacaucccacggagcucacggcguugcgguggccgcugaucuuaagagcacgcaggaggccauuaauaaaaucaccaagaaccuuaauucucuguccgagcucgaagucaagaaccugcagcgccugagcggggccauggacgagcuccauaaugaaauucuggagcuugaugagaaaguggacgaccugagagcugauacaaucucuagccaaauugaacucgccguccugcuuuccaacgagggaaucaucaauucugaagacgagcaucugcucgcgcuggaacggaagcugaaaaagaugcucggccccagcgcuguggauauugggaacggcuguuucgagaccaaacacaagugcaaucagacaugccuggacagaaucgccgccggaaccuuuaacgcuggcgaguucucccuuccuacguuugauagccugaauauuaccgccgcuucucucaacgacgaugggcuggacaaucacacaauccugcuuuauuacuccaccgccgcgagcucucucgccguuacacugaugauugcuaucuucauuguguauauggucucccgcgauaacgugagcuguuccaucugccuguga

SEQ ID NO: 210892 - RNA, 1752 nt, Artificial Sequence
  derived and/or modified sequence opt5 from hemagglutinin__InfluenzaB__AHL91200
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaccauccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacaacaaaacacagaugaagaaucuguauggcgauagcaacccgcagaaauuuaccucuuccgcuaaugggguuacaacccacuacgugagccaaauuggagacuucccuaaccagacggaggauggcggccucccccagucugggagaaucguggucgacuauauggugcagaagccuggaaagacaggcaccaucguuuaccaacgcggggugcugcuuccccagaaagucuggugcgccuccggacggagcaaggugauuaaaggcucccugccccucaucggggaggcugauugucugcaugaaaaguauggaggccugaacaaaucuaagccuuacuacaccggcgagcacgccaaagcgauugggaauugcccgaucuggguuaagacaccccucaagcuggccaacggaaccaaauauagaccucccgcuaagcugcugaaagaacggggcuuuuucggggccauugcuggauuucucgagggcgggugggagggcaugaucgccggauggcauggcuacacaagccacggggcccacggaguggcugucgcggccgaccugaaguccacgcaggaagcuaucaauaaaauuaccaagaaccuuaauagccugucugagcucgaagugaagaaccugcagcgccuguccggcgccauggaugagcuccauaaugaaauccuggagcuugacgagaaagucgacgaucugagagccgacacaauuagcucucaaaucgaacucgcugugcugcuuagcaacgaggggauuaucaauuccgaagaugagcaccuucucgcccuggaacggaagcugaaaaagaugcucggaccuucugcgguugacaucggcaacggguguuucgagaccaaacauaagugcaaucagacaugccuggauagaauugcugccggcaccuuuaacgccggagaguucagccuucccacguuugacucccugaauaucaccgcugccagccucaacgaugacggccuggauaaucacacaauucugcuuuauuacucuaccgcugccuccagccucgcggugacacugaugaucgccauuuucaucgucuauauggugucucgcgacaacguuuccuguagcauuugccuguga

SEQ ID NO: 210893 - RNA, 1752 nt, Artificial Sequence
  derived and/or modified sequence opt5 from hemagglutinin__InfluenzaB__AHL91211
augaaggccaucauugugcugcucauggucgcuaccagcaacgccgacagaaucugcacaggcauuacguccucuaauagcccccacguugugaaaaccgcgacacagggggaggugaacgucaccggagugaucucccugacaaccacaccuaccaagucucauuucgcuaaucuuaaaggcacgaagacccgggggaaacuguguccgaacugccucaauuguacagaucuggacguugcccuuggacgccccaugugcauuggcaccaucccuagcgccaaggcuuccauccugcacgaagugagacccgucacaucuggguguuuuccuauuaugcaugaucggaccaagauccgccaacuccccaaccugcugagaggauacgagcacauucggcucagcacgcauaaugugaucaacgccgaacgcgcuccuggcggcccguauagacuggggacauccggaagcugccccaauguuaccucucgguccggcuucuuugccacaauggcgugggccgugccucgcgacaacaaaaccgcuaccaauccccuuacagucgaggugccuuacauuuguacgaagggggaagaucagaucaccguguggggauuccacagcgacaacaaaacacagaugaagaaucuguauggcgauucuaacccccagaaauuuaccuccagcgccaauggggucacaacccacuacguuucucaaauuggaggcuucccgaaccagacggaggacggcgggcucccucaguccggaagaaucgugguggauuauaugguccagaagcccggcaagacagggaccaucguguaccaacggggaguucugcuuccucagaaaguguggugcgcuagcggccgcuccaaggucauuaaagggucucugccccucaucggagaggccgacugucugcaugaaaaguauggcggccugaacaaaagcaagcccuacuacaccggggagcacgcgaaagccauuggaaauugcccuaucugggugaagacaccgcucaagcuggcuaacggcaccaaauauagacccccugccaagcugcugaaagaacggggguuuuucggagcuauugccggcuuucucgaagggggcugggagggaaugaucgccggcuggcauggguacacaucccacggagcucacggcguugcgguggccgcugaucuuaagagcacgcaggaggccaucaauaaaauuaccaagaaccuuaauucucuguccgagcucgaagucaagaaccugcagcgccugagcggggccauggacgagcuccauaaugaaauccuggagcuugaugagaaaguggacgaccugagagcugauacaauuucuagccaaaucgaacucgccguccugcuuuccaacgagggaauuaucaauucugaagacgagcaucugcucgcgcuggaacggaagcugaaaaagaugcucggccccagcgcuguggauaucgggaacggcuguuucgagaccaaacacaagugcaaucagacaugccuggacagaauugccgccggaaccuuuaacgcuggcgaguucucccuuccuacguuugauagccugaauaucaccgccgcuucucucaacgacgaugggcuggacaaucacacaauucugcuuuauuacuccaccgccgcgagcucucucgccguuacacugaugaucgcuauuuucaucguguauauggucucccgcgauaacgugagcuguuccauuugccuguga

SEQ ID NO: 210894 - RNA, 1755 nt, Artificial Sequence
  derived and/or modified sequence opt5 from hemagglutinin__InfluenzaB__AHL91222
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcgucggcaccacacccucugccaaggccagcauucugcacgaagugagaccuguuaccuccggguguuuucccaucaugcaugaucggacgaagauccgccaacucccuaaccugcugagaggauacgagaauauucggcucucuacacagaacgugaucaaugcugaaaaagccccgggcggccccuaucgccuggggaccagcggauccugcccuaacgcuacaagcagaucuggcuucuuugccaccauggcgugggccgucccccgggacaauaacaagaccgcuacaaauccucuuacgguggaggugcccuacgucuguaccgaaggggaggaucagauuacaguuuggggauuccacuccgacaacaaaacccagaugaagaaucuguauggcgauagcaacccgcaaaaauuuacaucuuccgccaacggggugaccacgcauuacgugagccagaucggaggcuucccugaccagacagaggauggcgggcucccccagucuggacgcauugucguggacuauaugguucaaaagccuggcaagaccgggaccaucguguaccagagaggaguccugcuuccccagaaaguguggugcgcuuccggccggagcaagguuauuaaagggucccugccccucaucggagaagccgauugucugcacgagaaguauggcggccugaauaaaucuaagccuuacuacacaggggaacacgcgaaagccaucggaaacugcccgauuugggugaagacaccccucaagcuggcuaauggcaccaaauaucgcccucccgccaagcugcugaaagagagaggguuuuucggagcuaucgccggcuuucucgaagggggcugggaaggaaugauugccggcuggcauggguacacgagccacggagcucauggcgucgcgguggccgcugaccugaaguccacccaggaggccaucaacaaaauuacaaagaaucuuaacagccugucugaacucgaggucaagaaucugcaacggcuguccggggccauggaugaacuccacaacgagauccuggagcuugacgaaaaaguggacgaucugcgcgcugacaccaucagcucucagauugagcucgccguucugcuuagcaaugaaggaaucauuaacuccgaggaugaacaccuucucgcgcuggagagaaagcugaaaaagaugcucggcccuucugcuguggacaucgggaauggcuguuucgagacaaaacauaagugcaaccagaccugccuggaucggauugccgccggaacguuuaaugcuggcgaguucagccuucccaccuuugacucccugaacaucacagccgcuagccucaaugaugacgggcuggauaaccacaccauccugcuuuauuacucuacagccgcguccagccucgccgucacccugaugauugcuaucuucauuguguauaugguuucuagagacaacaucuccuguagcauuugccuguga

SEQ ID NO: 210895 - RNA, 1755 nt, Artificial Sequence
  derived and/or modified sequence opt5 from hemagglutinin__InfluenzaB__AHL91244
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcacaacccccucugccaaggccagcauucugcacgaagugagaccuguuacguccggguguuuucccaucaugcaugaucggacaaagauccgccaacucccuaaucugcugagaggauacgagaaaauucggcucucuacccagaacgugaucaaugcugaaaaggccccgggcggccccuaucgccuggggacaagcggauccugcccuaacgcuaccagcagaucuggcuucuuugccaccauggcgugggccgucccccgggacaauaacaaaacagcuacgaauccucuuaccguggaggugcccuacauuuguacaaaggaagaggaucagaucaccgucuggggguuccacuccgacaacaaaacacagaugaagaaucuguauggagauagcaacccgcaaaaguuuaccucuuccgccaauggcguuacgacacauuacgugagccagauugggggauucccugaccagaccgaggauggcggccucccccagucugggcgcaucguggucgacuauauggugcaaaaaccuggaaagaccggcacaauuguuuaccagagaggggugcugcuuccccagaaagucuggugcgcuuccggacggagcaaggugaucaaaggcucccugccccucaucggggaagccgauugucugcacgagaaguauggaggccugaacaaaucuaagccuuacuacaccggcgaacacgcgaaggccauugggaacugcccgaucuggguuaaaacaccccucaagcuggcuaauggaacgaaauaucgcccucccgccaagcugcugaaagagagaggcuuuuucggggcuauugccggauuucucgagggcgggugggaaggcaugaucgccggauggcauggcuacaccagccacggggcucauggaguggcggucgccgcugaccugaaguccacacaggaggccauuaacaagaucaccaaaaaucuuaacagccugucugaacucgaggugaagaaucugcaacggcuguccggcgccauggaugaacuccacaacgagauccuggagcuugacgaaaaagucgacgaucugcgcgcugacacaauuagcucucagaucgagcucgccgugcugcuuagcaaugaagggauuaucaacuccgaggaugaacaccuucucgcgcuggagagaaagcugaaaaagaugcucggaccuucugcuguugacauuggcaauggguguuucgagaccaagcauaaaugcaaccagacgugccuggaucggaucgccgccggcaccuuuaaugcuggagaguucagccuucccacauuugacucccugaacaucaccgccgcuagccucaaugaugacggccuggauaaccacacaauucugcuuuauuacucuaccgccgcguccagccucgccgugacgcugaugaucgcuauuuucaucgucuauauggugucuagagacaauguuuccuguagcauuugccuguga

SEQ ID NO: 210896 - RNA, 1755 nt, Artificial Sequence; identical to SEQ ID NO: 209525
  derived and/or modified sequence opt5 from hemagglutinin__InfluenzaB__AHL91255

SEQ ID NO: 210897 - RNA, 1755 nt, Artificial Sequence; identical to SEQ ID NO: 209525
  derived and/or modified sequence opt5 from hemagglutinin__InfluenzaB__AHL91266

SEQ ID NO: 210898 - RNA, 1752 nt, Artificial Sequence
  derived and/or modified sequence opt5 from hemagglutinin__InfluenzaB__AHL91277
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaacugccucaauuguacagaucuggacguggcucuuggacgcccuaugugcauuggcaucacccccucugccaaggccagcauccugcacgaagucagaccugugacauccggguguuuucccauuaugcaugaucggaccaagauccgccaacucccuaaccugcugagaggauacgagcacauucggcucucuacgcauaauguuaucaacgcugaacgcgccccgggcggccccuauagacuggggacaagcggauccugcccuaaugugaccagccggucuggcuucuuugcuacaauggccugggcggucccccgcgacaacaaaaccgccaccaauccucuuacaguggaggugcccuacauuuguacgaagggggaagaucagaucaccgucuggggauuccacuccgacaacaaaacacagaugaagaaucuguauggcgauagcaacccgcagaaauuuaccucuuccgcuaaugggauuacaacccacuacguuagccaaaucggaggcuucccuaaccagacggaggacggcgggcucccccagucuggaagaaucgugguggauuauaugguccagaagccuggcaagacagggaccauuguguaccaacggggaguucugcuuccccagaaaguguggugcgccuccggccgcagcaaggucaucaaagggucccugccccucauuggagaggcugacugucugcaugaaaaguauggcggccugaacaaaucuaagccuuacuacaccggggagcacgccaaagcgaucggaaauugcccgauuugggugaagacaccccucaagcuggccaacggcaccaaauauagaccucccgcuaagcugcugaaagaacggggguuuuucggagccaucgcuggcuuucucgaagggggcugggagggaaugaucgccggcuggcauggguacacaagccacggagcccacggcguugcuguggcggccgaucugaaguccacgcaggaggcuauuaauaaaaucaccaagaaccuuaauagccugucugagcucgaagucaagaaccugcagcgccuguccggggccauggacgagcuccauaaugaaauucuggagcuugaugagaaaguggacgaccugagagccgauacaaucagcucucaaauugaacucgcuguccugcuuagcaacgagggaaucaucaauuccgaagacgagcaccuucucgcccuggaacggaagcugaaaaagaugcucggcccuucugcgguggauauugggaacggcuguuucgagaccaaacauaagugcaaucagacaugccuggacagaaucgcugccggaaccuuuaacgccggcgaguucagccuucccacguuugauucccugaauauuaccgcugccagccucaacgacgaugggcuggacaaucacacaauccugcuuuauuacucuaccgcugccuccagccucgcgguuacacugaugauugccaucuucauuguguauauggucucucgcgauaacguguccuguagcaucugccuguga

SEQ ID NO: 210899 - RNA, 1755 nt, Artificial Sequence
  derived and/or modified sequence opt5 from hemagglutinin__InfluenzaB__AHL91299
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgacccggucccauuucgcgaaucuuaagggcacgaaaacccgcgggaagcugugucccacaugccucaacuguaccgaucuggacguggcucuuggaagaccuaugugcgucggcacaacccccucugccaaagccagcauucugcacgaagugcggccuguuacguccggguguuuucccaucaugcaugaucgcacaaagaucagacaacucccuaaucugcugcggggauacgagaagauucgccucucuacccagaacgugaucaaugcugaaaaagccccgggcggccccuauagacuggggacaagcggauccugcccuaacgcuaccagccggucuggcuucuuugccaccauggcgugggccgucccccgcgacaauaacaagacagcuacgaauccucuuaccguggaggugcccuacauuuguacaaaagaagaggaucagaucaccgucuggggguuccacuccgacaacaagacacagaugaaaaaucuguauggagauagcaacccgcaaaaguuuaccucuuccgccaauggcguuacgacacauuacgugagccagauugggggauucccugaccagaccgaggauggcggccucccccagucugggagaaucguggucgacuauauggugcaaaagccuggaaaaaccggcacaauuguuuaccagcgggggauccugcuuccccagaagguguggugcgcuuccggacgcagcaaagucaucaagggcucccugccccucauuggggaagccgauugucugcacgagaaauauggaggccugaacaagucuaaaccuuacuacaccggcgaacacgcgaaggccaucgggaacugcccgauuugggugaagacaccccucaaacuggcuaauggaacgaaguauagaccucccgccaaacuucugaaggagcggggcuuuuucggggcuaucgccggauuucucgagggcgggugggaaggcaugauugccggauggcauggcuacaccagccacggggcucauggaguugcgguggccgcugaccugaaauccacacaggaggccaucaacaagaucaccaagaaucuuaacagccugucugaacucgaggucaaaaaucugcaacgccuguccggcgccauggaugaacuccacaacgagauucuggagcuugacgaaaagguggacgaucugagagcugacacaaucagcucucagauugagcucgccguccugcuuagcaaugaagggaucauuaacuccgaggaugaacaucugcucgcgcuggagcggaaacugaagaaaaugcucggaccuucugcuguggacaucggcaauggguguuucgagaccaagcacaagugcaaccagacgugccuggauagaaucgccgccggcaccuuuaaugcuggagaguucagccuucccacauuugacucccugaacauuaccgccgcuagccucaaugaugacggccuggauaaccacacaauccugcuuuauuacucuaccgccgcguccagccucgccguuacgcugaugauugcuaucuucauuguguauaugaucucucgcgacaaugucuccuguagcauuugccuguga

SEQ ID NO: 210900 - RNA, 1755 nt, Artificial Sequence
  derived and/or modified sequence opt5 from hemagglutinin__InfluenzaB__AHL91310
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcacaacccccucugccaaggccagcauucugcacgaagugagaccuguuacguccggguguuuucccaucaugcaugaucggacaaagauccgccaacucccuaaucugcugagaggauacgagaaaauucggcucucuacccagaacgugaucaaugcugaaaaggccccgggcggccccuaucgccuggggacaagcggauccugcccuaacgcuaccagcagaucuggcuucuuugccaccauggcgugggccgucccccgggacaauaacaaaacagcuacgaauccucuuaccguggaggugcccuacauuuguacaaaggaagaggaucagaucaccgucuggggguuccacuccgacaacaaaacacagaugaagaaucuguauggagauagcaacccgcaaaaguuuaccucuuccgccaauggcguuacgacacauuacgugagccagauugggggauucccugaccagaccgaggauggcggccucccccagucugggcgcaucguggucgacuauauggugcaaaaaccuggaaagaccggcacaauuguuuaccagagagggauccugcuuccccagaaaguguggugcgcuuccggacggagcaaggucaucaaaggcucccugccccucauuggggaagccgauugucugcacgagaaguauggaggccugaacaaaucuaagccuuacuacaccggcgaacacgcgaaggccaucgggaacugcccgauuugggugaaaacaccccucaagcuggcuaauggaacgaaauaucgcccucccgccaagcugcugaaagagagaggcuuuuucggggcuaucgccggauuucucgagggcgggugggaaggcaugauugccggauggcauggcuacaccagccacggggcucauggaguugcgguggccgcugaccugaaguccacacaggaggccaucaacaagaucaccaaaaaucuuaacagccugucugaacucgaggucaagaaucugcaacggcuguccggcgccauggaugaacuccacaacgagauucuggagcuugacgaaaaaguggacgaucugcgcgcugacacaaucagcucucagauugagcucgccguccugcuuagcaaugaagggaucauuaacuccgaggaugaacaccuucucgcgcuggagagaaagcugaaaaagaugcucggaccuucugcuguggacaucggcaauggguguuucgagaccaagcauaaaugcaaccagacgugccuggaucggaucgccgccggcaccuuuaaugcuggagaguucagccuucccacauuugacucccugaacauuaccgccgcuagccucaaugaugacggccuggauaaccacacaauccugcuuuauuacucuaccgccgcguccagccucgccguuacgcugaugauugcuaucuucauuguguauaugaucucuagagacaaugucuccuguagcauuugccuguga

SEQ ID NO: 210901 - RNA, 1755 nt, Artificial Sequence
  derived and/or modified sequence opt5 from hemagglutinin__InfluenzaB__AHL91321
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccacaugccucaacuguaccgaucuggacguggcucuuggacgcccuaugugcgucggcacaacccccucugccaaggccagcauucugcacgaagugagaccuguuacguccggguguuuucccaucaugcaugaucggacaaagauccgccaacucccuaaucugcugagaggauacgagaaaauucggcucucuacccagaacgugaucaaugcugaaaaggccccgggcggccccuaucgccuggggacaagcggauccugcccuaacgcuaccagcagaucuggcuucuuugccaccauggcgugggccgucccccgggacaauaacaaaacagcuacgaauccucuuaccguggaggugcccuacauuuguacaaaggaagaggaucagaucaccgucuggggguuccacuccgacaacaaaacacagaugaagaaucuguauggagauagcaacccgcaaaaguuuaccucuuccgccaauggcguuacgacacauuacgugagccagauugggggauucccugaccagaccgaggauggcggccucccccagucugggcgcaucguggucgacuauauggugcaaaaaccuggaaagaccggcacaauuguuuaccagagaggggugcugcuuccccagaaagucuggugcgcuuccggacggagcaaggugaucaaaggcucccugccccucaucggggaagccgauugucugcacgagaaguauggaggccugaacaaaucuaagccuuacuacaccggcgaacacgcgaaggccauugggaacugcccgaucuggguuaaaacaccccucaagcuggcuaauggaacgaaauaucgcccucccgccaagcugcugaaagagaagggcuuuuucggggcuauugccggauuucucgagggcgggugggaaggcaugaucgccggauggcauggcuacaccagccacggggcucauggaguggcggucgccgcugaccugaaguccacacaggaggccauuaacaaaaucaccaagaaucuuaacagccugucugaacucgaggugaaaaaucugcaaagacuguccggcgccauggaugaacuccacaacgagauccuggagcuugacgaaaaggucgacgaucugcgggcugacacaauuagcucucagaucgagcucgccgugcugcuuagcaaugaagggauuaucaacuccgaggaugaacaccuucucgcgcuggagcgcaaacugaagaagaugcucggaccuucugcuguugacauuggcaauggguguuucgagaccaaacauaagugcaaccagacgugccuggauagaaucgccgccggcaccuuuaaugcuggagaguucagccuucccacauuugacucccugaacaucaccgccgcuagccucaaugaugacggccuggauaaccacacaauucugcuuuauuacucuaccgccgcguccagccucgccgugacgcugaugaucgcuauuuucaucgucuauauggugucucgggacaauguuuccuguagcauuugccuguga

SEQ ID NO: 210902 - RNA, 1755 nt, Artificial Sequence; identical to SEQ ID NO: 210900
  derived and/or modified sequence opt5 from hemagglutinin__InfluenzaB__AHL91332

SEQ ID NO: 210903 - RNA, 1755 nt, Artificial Sequence; identical to SEQ ID NO: 210900
  derived and/or modified sequence opt5 from hemagglutinin__InfluenzaB__AHL91343

SEQ ID NO: 210904 - RNA, 1755 nt, Artificial Sequence; identical to SEQ ID NO: 210900
  derived and/or modified sequence opt5 from hemagglutinin__InfluenzaB__AHL91354

SEQ ID NO: 210905 - RNA, 1755 nt, Artificial Sequence; identical to SEQ ID NO: 209503
  derived and/or modified sequence opt5 from hemagglutinin__InfluenzaB__AHL91365

SEQ ID NO: 210906 - RNA, 1755 nt, Artificial Sequence
  derived and/or modified sequence opt5 from hemagglutinin__InfluenzaB__AHL91376
augaaggccaucauugugcugcucauggucguuaccagcaacgcugacagaaucugcacaggcauuacguccucuaauagcccccacguggugaaaaccgccacacagggggaagucaacgugaccggaguuaucccucugacagcgaccccgacaaagucccauuucgcuaaucuuaaaggcaccaagacgcgggggaaacuguguccuaccugccucaacuguacagaucuggacguggcccuuggacgccccaugugcgucggcgugacccccucugccaaggcuagcauucugcacgaaguuagaccugugacauccggguguuuucccaucaugcaugaucggaccaagauccgccaacucccuaaucugcugagaggauacgagaaaauucggcucucuacgcagaacgucaucaaugccgaaaaggcuccgggcggccccuaucgccuggggacaagcggauccugcccuaacgccaccagcagaucuggcuucuuugcgacaauggccugggcugugccccgggacaauaacaaaaccgccaccaauccucuuacaguggaggucccccacauuuguacgaaggaagaggaucagaucaccguuuggggguuccauuccgacaacaaaacacagaugaagaaucuguacggagauagcaacccgcaaaaguuuaccucuuccgcuaauggcgugacaacccacuaugugagccagauugggggauucccugaccagacggaggauggcggccucccccagucugggcgcaucgucguggacuacaugguucaaaaaccuggaaagacaggcaccauuguguaucagagagggauccugcuuccccagaaagucuggugcgccuccggacggagcaaggugaucaaaggcucccugccccucauuggggaagcggauugucugcacgagaaguacggaggccugaacaaaucuaagccuuauuacaccggcgaacaugccaaggcuaucgggaacugcccgauuuggguuaaaacaccccucaagcuggccaauggaaccaaauaccgcccucccgcuaaacuucugaaggagagaggcuuuuucggggccaucgccggauuucucgagggcgggugggaaggcaugauugcuggauggcacggcuauacaagccauggggcgcacggaguggccgucgcugccgaccugaaguccacgcaggaggccaucaacaagaucaccaaaaaucuuaacagccugucugaacucgaggugaagaaucugcaacggcuguccggcgcuauggaugaacuccacaacgagauucuggagcuugacgaaaaagucgacgaucugcgcgccgacacaaucagcucucagauugagcucgcggugcugcuuagcaaugaagggaucauuaacuccgaggaugaacaucugcucgcucuggagagaaagcugaaaaagaugcucggaccuucugccguugacaucggcaauggguguuucgagaccaagcacaaaugcaaccagacaugccuggaucggaucgccgcuggcaccuuuaaugccggagaguucagccuucccacguuugacucccugaacauuaccgcugccagccucaaugaugacggccuggauaaccauacaauccugcuuuacuauucuaccgcggccuccagccucgcugugacacugaugauugccaucuucauugucuacaugaucucuagagacaauguguccuguagcauuugccuguga

SEQ ID NO: 210907 - RNA, 1755 nt, Artificial Sequence
  derived and/or modified sequence opt5 from hemagglutinin__InfluenzaB__AHL91387
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccggcgaagucccauuucgcuaaucuuaaaggcaccaagacgcgggggaaacuguguccuaccugccucaacuguacagaucuggacguggcccuuggacgccccaugugcgucggcgugacccccucugccaaggcuagcauucugcacgaaguuagaccugugacauccggguguuuucccaucaugcaugaucggaccaagauccgccaacucccuaaucugcugagaggauacgagaaaauucggcucucuacgcagaacgucaucaaugccgaaaaggcuccgggcggccccuaucgccuggggacaagcggauccugcccuaacgccaccagcagaucuggcuucuuugcgacaauggccugggcugugccccgggacaauaacaaaaccgccaccaauccucuuacaguggaggucccccacauuuguacgaaggaagaggaucagaucaccguuuggggguuccauuccgacaacaaaacacagaugaagaaucuguacggagauagcaacccgcaaaaguuuaccucuuccgcuaauggcgugacaacccacuaugugagccagauugggggauucccugaccagacggaggauggcggccucccccagucugggcgcaucgucguggacuacaugguucaaaaaccuggaaagacaggcaccauuguguaucagagagggauccugcuuccccagaaagucuggugcgccuccggacggagcaaggugaucaaaggcucccugccccucauuggggaagcggauugucugcacgagaaguacggaggccugaacaaaucuaagccuuauuacaccggcgaacaugccaaggcuaucgggaacugcccgauuuggguuaaaacaccccucaagcuggccaauggaaccaaauaccgcccucccgcuaaacuucugaaggagagaggcuuuuucggggccaucgccggauuucucgagggcgggugggaaggcaugauugcuggauggcacggcuauacaagccauggggcgcacggaguggccgucgcugccgaccugaaguccacgcaggaggccaucaacaagaucaccaaaaaucuuaacagccugucugaacucgaggugaagaaucugcaacggcuguccggcgcuauggaugaacuccacaacgagauucuggagcuugacgaaaaagucgacgaucugcgcgccgacacaaucagcucucagauugagcucgcggugcugcuuagcaaugaagggaucauuaacuccgaggaugaacaucugcucgcucuggagagaaagcugaaaaagaugcucggaccuucugccguugacaucggcaauggguguuucgagaccaagcacaaaugcaaccagacaugccuggaucggaucgccgcuggcaccuuuaaugccggagaguucagccuucccacguuugacucccugaacauuaccgcugccagccucaaugaugacggccuggauaaccauacaauccugcuuuacuauucuaccgcggccuccagccucgcugugacacugaugauugccaucuucauugucuacaugaucucuagagacaauguguccuguagcauuugccuguga

SEQ ID NO: 210908 - RNA, 1755 nt, Artificial Sequence
  derived and/or modified sequence opt5 from hemagglutinin__InfluenzaB__AHL91409
augaaggccaucauugugcugcucauggucguuaccagcaacgcugacagaaucugcacaggcauuacguccucugauagcccccacguggugaaaaccgccacacagggggaagucaaugugaccggagcgaucccucugacaaccacaccgaccaaguccuacuucgcuaaccuuaaaggcacgaagacccgggggaaacugugucccacaugccucaauuguaccgaccuggauguugcccuuggacgcccuaugugcgugggcauuacacccucugccaaggcuagcauccugcaugaagucagaccugugaccuccggguguuuucccaucaugcacgaccggacgaagauucgccaacucccuaaccugcugagaggauaugagaaaauccggcucucuacacagaauguuauuaacgccgaaaaggcuccgggcggccccuaccgccuggggaccagcggauccugcccuaaugccacaagcagaucuggcuucuuugcgaccauggccugggcugugccccgggauaacaauaaaaccgccacaaacccucuuacggucgaggugccccauaucuguaccaaggaagaggaccagauuacaguguggggguuccacuccgauaauaaaacccagaugaagaaccuguauggagacagcaauccgcaaaaguuuacaucuuccgcuaacggcaucaccacgcauuacgucagccagauugggggauucccugaucagacagaggacggcggccucccccagucugggcgcaucguuguggauuauauggugcaaaaaccuggaaagaccggcaccaucgucuaccagagagggauucugcuuccccagaaaguguggugcgccuccggacggagcaagguuaucaaaggcucccugccccucauuggggaagcggacugucugcacgagaaguauggaggccugaauaaaucuaagccuuacuacacaggcgaacacgccaaggcuaucgggaacugcccgauuugggugaaaacaccccucaagcuggccaacggaacaaaauaucgcccucccgcuaagcugcugaaagagagaggcuuuuucggggccaucgccggauuucucgagggcgggugggaaggcauggucgcuggauggcauggcuacacgagccacggggcgcauggaguggccguugcugccgaucugaaguccacccaggaggccaucaauaagauuaccaaaaaccuuaauagccugucugaacucgaggugaagaaccugcaacggcuguccggcgcuauggacgaacuccacaaugagauccuggagcuugacgaaaaagucgaugaccugcgcgccgauaccauuagcucucagaucgagcucgcggugcugcuuagcaacgaagggauuaucaauuccgaggacgaacaccuucucgcucuggagagaaagcugaaaaagaugcucggaccuucugccgucgauaucggcaacggguguuucgagacaaagcauaaaugcaaucagaccugccuggaccggauugccgcuggcacguuuaacgccggagaguucagccuucccaccuuugauucccugaauaucacagcugccagccucaacgacgauggccuggacaaucacaccauucugcuuuauuacucuacagcggccuccagccucgcugugacccugaugaucgccauuuucaucguuuauaugauuucuagagauaacguguccuguagcaucugccuguga

SEQ ID NO: 210909 - RNA, 1755 nt, Artificial Sequence
  derived and/or modified sequence opt5 from hemagglutinin__InfluenzaB__AHL91431
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacaacaagacccagaugaagaaucuguacggagauagcaacccgcaaaaauuuacaucuuccgcuaauggcaucaccacgcacuaugucagccagauugggggauucccugaccagacagaggauggcggccucccccagucugggcggaucguuguggacuacauggugcaaaagccuggaaaaaccggcaccaucgucuaucagcgcgggauucugcuuccccagaagguguggugcgccuccggaagaagcaaaguuaucaagggcucccugccccucauuggggaagcggauugucugcacgagaaauacggaggccugaacaagucuaagccuuauuacacaggcgaacaugccaaagcuaucgggaacugcccgauuugggugaagacaccccucaaacuggccaauggaaccaaguaccggccucccgcuaaacuucugaaggagcgcggcuuuuucggggccaucgccggauuucucgagggcgggugggaaggcaugaucgcuggauggcacggcuauacgagccauggggcgcacggagucgccguggcugccgaccugaaguccacccaggaggccauuaacaaaaucacaaagaaucuuaacuuccugagcgaacucgagguuaaaaaucugcaaagacugucuggcgcuauggaugaacuccacaacgagauucuggagcuugacgaaaagguggacgaucugcgggccgacaccaucuccagccagauugagcucgcgguccugcuuucuaaugaagggaucaucaacagcgaggaugaacaucugcucgcucuggagcgcaaacugaagaagaugcucggaccuuccgccguggacauuggcaauggguguuuugagacaaaacacaagugcaaccagaccugccuggauagaaucgccgcuggcacguucaaugccggagaauuuucucuucccaccuucgacagccugaacauuacagcugccucccucaaugaugacggccuggauaaccauaccauccugcuuuacuauagcacagcggccucuucccucgcugucacccugaugauugccaucuucauuguguacaugaucagccgggacaauguuucuuguuccaucugccuguga

SEQ ID NO: 210910 - RNA, 1755 nt, Artificial Sequence
  derived and/or modified sequence opt5 from hemagglutinin__InfluenzaB__AHL91442
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaccgcuccgggcggccccuaucgccuggggacaagcggauccugcccuaacgccaccagcaagucuggcuucuuugcgaccauggccugggcugugcccagagacaauaacaaaacagccacgaauccucuuaccgucgaggugccccacaucuguacaaaggaagaggaucagauuaccguguggggguuccauuccgacaacaaaacacagaugaagaaucuguacggagauagcaacccgcaaaaguuuaccucuuccgcuaauggcaucacgacacacuaugucagccagauugggggauucccugaccagaccgaggauggcggccucccccagucugggcggaucguuguggacuacauggugcaaaaaccuggaaagaccggcacaaucgucuaucagcgcgggauucugcuuccccagaaaguguggugcgccuccggaagaagcaagguuaucaaaggcucccugccccucauuggggaagcggauugucugcacgagaaguacggaggccugaacaaaucuaagccuuauuacaccggcgaacaugccaaggcuaucgggaacugcccgauuugggugaaaacaccccucaagcuggccaauggaacgaaauaccggccucccgcuaaacuucugaaggagcgcggcuuuuucggggccaucgccggauuucucgagggcgggugggaaggcaugaucgcuggauggcacggcuauaccagccauggggcgcacggagucgccguggcugccgaccugaaguccacacaggaggccauuaacaagaucaccaaaaaucuuaacagccugucugaacucgagguuaagaaucugcaaagacuguccggcgcuauggaugaacuccacaacgagauucuggagcuugacgaaaaaguggacgaucugcgggccgacacaaucagcucucagauugagcucgcgguccugcuuagcaaugaagggaucaucaacuccgaggaugaacaucugcucgcucuggagcgcaagcugaaaaagaugcucggaccuucugccguggacauuggcaauggguguuucgagaccaagcacaaaugcaaccagacgugccuggauagaaucgccgcuggcaccuuuaaugccggagaguucagccuucccacauuugacucccugaacauuaccgcugccagccucaaugaugacggccuggauaaccauacaauccugcuuuacuauucuaccgcggccuccagccucgcugucacgcugaugauugccaucuucauuguguacaugaucucucgggacaauguuuccuguagcaucugccuguga

SEQ ID NO: 210911 - RNA, 1755 nt, Artificial Sequence
  derived and/or modified sequence opt5 from hemagglutinin__InfluenzaB__AHL91453
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacgaucgaggucccccacguguguaccaaagaagaggaucagauuacaguguggggguuccauuccgacaacaagacccagaugaagaaucuguacggagauagcaacccgcaaaaauuuacaucuuccgcuaauggcaucaccacgcacuaugucagccagauugggggauucccugaccagacagaggauggcggccucccccagucugggcggaucguuguggacuacauggugcaaaagccuggaaaaaccggcaccaucgucuaucagcgcgggauucugcuuccccagaagguguggugcgccuccggaagaagcaaaguuaucaagggcucccugccccucauuggggaagcggauugucugcacgagaaauacggaggccugaacaagucuaagccuuauuacacaggcgaacaugccaaagcuaucgggaacugcccgauuugggugaagacaccccucaaacuggccaauggaaccaaguaccggccucccgcuaaacuucugaaggagcgcggcuuuuucggggccaucgccggauuucucgagggcgggugggaaggcaugaucgcuggauggcacggcuauacgagccauggggcgcacggagucgccguggcugccgaccugaaguccacccaggaggccauuaacaaaaucacaaagaaucuuaacagccugucugaacucgagguuaaaaaucugcaaagacuguccggcgcuauggaugaacuccacaacgagauucuggagcuugacgaaaagguggacgaucugcgggccgacaccaucagcucucagauugagcucgcgguccugcuuagcaaugaagggaucaucaacuccgaggaugaacaucugcucgcucuggagcgcaaacugaagaagaugcucggaccuucugccguggacauuggcaauggguguuucgagacaaaacacaagugcaaccagaccugccuggauagaaucgccgcuggcacguuuaaugccggagaguucagccuucccaccuuugacucccugaacauuacagcugccagccucaaugaugacggccuggauaaccauaccauccugcuuuacuauucuacagcggccuccagccucgcugucacccugaugauugccaucuucauuguguacaugaucucucgggacaauguuuccuguagcaucugccuguga

SEQ ID NO: 210912 - RNA, 1755 nt, Artificial Sequence; identical to SEQ ID NO: 209429
  derived and/or modified sequence opt5 from hemagglutinin__InfluenzaB__AHL91464

SEQ ID NO: 210913 - RNA, 1755 nt, Artificial Sequence; identical to SEQ ID NO: 209535
  derived and/or modified sequence opt5 from hemagglutinin__InfluenzaB__AHL91475

SEQ ID NO: 210914 - RNA, 1755 nt, Artificial Sequence; identical to SEQ ID NO: 210910
  derived and/or modified sequence opt5 from hemagglutinin__InfluenzaB__AHL91486

SEQ ID NO: 210915 - RNA, 1755 nt, Artificial Sequence; identical to SEQ ID NO: 210910
  derived and/or modified sequence opt5 from hemagglutinin__InfluenzaB__AHL91497

SEQ ID NO: 210916 - RNA, 1755 nt, Artificial Sequence; identical to SEQ ID NO: 210910
  derived and/or modified sequence opt5 from hemagglutinin__InfluenzaB__AHL91530

SEQ ID NO: 210917 - RNA, 1755 nt, Artificial Sequence; identical to SEQ ID NO: 209429
  derived and/or modified sequence opt5 from hemagglutinin__InfluenzaB__AHL91541

SEQ ID NO: 210918 - RNA, 1755 nt, Artificial Sequence; identical to SEQ ID NO: 210910
  derived and/or modified sequence opt5 from hemagglutinin__InfluenzaB__AHL91552

SEQ ID NO: 210919 - RNA, 1755 nt, Artificial Sequence; identical to SEQ ID NO: 210910
  derived and/or modified sequence opt5 from hemagglutinin__InfluenzaB__AHL91574

SEQ ID NO: 210920 - RNA, 1755 nt, Artificial Sequence
  derived and/or modified sequence opt5 from hemagglutinin__InfluenzaB__AHL91585
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacaacaagacccagaugaagaaucuguacggagauagcaacccgcaaaaauuuacaucuuccgcuaauggcaugaccacgcacuaugucagccagaucgggggauucccugaccagacagaggauggcggccucccccagucugggcggauuguuguggacuacauggugcaaaagccuggaaaaaccggcaccaucgucuaucagcgcgggauccugcuuccccagaagguguggugcgccuccggaagaagcaaaguuauuaagggcucccugccccucaucggggaagcggauugucugcacgagaaauacggaggccugaacaagucuaagccuuauuacacaggcgaacaugccaaagcuauugggaacugcccgaucugggugaagacaccccucaaacuggccaauggaaccaaguaccggccucccgcuaaacuucugaaggagcgcggcuuuuucggggccauugccggauuucucgagggcgggugggaaggcaugaucgcuggauggcacggcuauacgagccauggggcgcacggagucgccguggcugccgaccugaaguccacccaggaggccaucaacaaaauuacaaagaaucuuaacagccugucugaacucgagguuaaaaaucugcaaagacuguccggcgcuauggaugaacuccacaacgagauccuggagcuugacgaaaagguggacgaucugcgggccgacaccauuagcucucagaucgagcucgcgguccugcuuagcaaugaagggauuaucaacuccgaggaugaacaucugcucgcucuggagcgcaaacugaagaagaugcucggaccuucugccguggacaucggcaauggguguuucgagacaaaacacaagugcaaccagaccugccuggauagaauugccgcuggcacguuuaaugccggagaguucagccuucccaccuuugacucccugaacaucacagcugccagccucaaugaugacggccuggauaaccauaccauucugcuuuacuauucuacagcggccuccagccucgcugucacccugaugaucgccauuuucaucguguacaugauuucucgggacaauguuuccuguagcaucugccuguga

SEQ ID NO: 210921 - RNA, 1755 nt, Artificial Sequence
  derived and/or modified sequence opt5 from hemagglutinin__InfluenzaB__AHL91596
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacggucgaggugccccacaucuguaccaaagaagaggaucagauuacaguguggggguuccauuccgacaacaagacccagaugaagaaucuguacggagauagcaacccgcaaaaauuuacaucuuccgcuaauggcaucaccacgcacuaugucagccagauugggggauucccugaccagacagaggauggcggccucccccagucugggcggaucguuguggacuacauggugcaaaagccuggaaaaaccggcaccaucgucuaucagcgcgggauucugcuuccccagaagguguggugcgccuccggaagaagcaaaguuaucaagggcucccugccccucauuggggaagcggauugucugcacgagaaauacggaggccugaacaagucuaagccuuauuacacaggcgaacaugccaaagcuaucgggaacugcccgauuugggugaagacaccccucaaacuggccaauggaaccaaguaccggccucccgcuaaaauccuuaaggagcgcggcuuuuucggggccaucgccggauuucuggagggcgggugggaaggcaugauugcuggauggcacggcuauacgagccauggggcgcacggagucgccguggcugccgaccucaaguccacccaggaggccaucaacaaaauuacaaagaaucugaacagccuuucugaacuggagguuaaaaaucuccaaagacuguccggcgcuauggaugaacugcacaacgagauccucgagcuggacgaaaagguggacgaucuucgggccgacaccauuagcucucagaucgagcuggcgguccuccugagcaaugaagggaucauuaacuccgaggaugaacaucuucuggcucucgagcgcaaacugaagaagaugcugggaccuucugccguggacaucggcaauggguguuucgagacaaaacacaagugcaaccagaccugccucgauagaauugccgcuggcacguuuaaugccggagaguucagccugcccaccuuugacucccuuaacaucacagcugccagccugaaugaugacggccucgauaaccauaccauucugcuguacuauucuacagcggccuccagccuugcugucacccucaugaucgccauuuucaucguguacaugaucucucgggacaauguuuccuguagcauuugccuguga

SEQ ID NO: 210922 - RNA, 1755 nt, Artificial Sequence; identical to SEQ ID NO: 210921
  derived and/or modified sequence opt5 from hemagglutinin__InfluenzaB__AHL91607

SEQ ID NO: 210923 - RNA, 1755 nt, Artificial Sequence
  derived and/or modified sequence opt5 from hemagglutinin__InfluenzaB__AHL91618
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaccgcuccgggcggccccuaucgccuggggacaagcggauccugcccuaacgccaccagcaagucuggcuucuuugcgaccauggccugggcugugcccagagacaauaacaaaacagccacgaauccucuuaccgucgaggugccccacaucuguacaaaggaagaggaucagauuaccguguggggguuccauuccgacaacaaaacacagaugaagaaucuguacggagauagcaacccgcaaaaguuuaccucuuccgcuaauggcaucacgacacacuaugucagccagauugggggauucccugaccagaccgaggauggcggccucccccagucugggcggaucguuguggacuacauggugcaaaaaccuggaaagaccggcacaaucgucuaucagcgcgggauucugcuuccccagaaaguguggugcgccuccggaagaagcaagguuaucaaaggcucccugccccucauuggggaagcggauugucugcacgagaaguacggaggccugaacaaaucuaagccuuauuacaccggcgaacaugccaaggcuaucgggaacugcccgauuugggugaaaacaccccucaagcuggccaauggaacgaaauaccggccucccgcuaaacuucugaaggagcgcggcuuuuucggggccaucgccggauuucucgagggcgggugggaaggcaugaucgcuggauggcacggcuauaccagccauggggcgcacggagucgccguggcugccgaccugaaguccacacaggaggccauuaacaagaucaccaaaaaucuuaacagccugucugaacucgagguuaagaaucugcaaagacuguccggcgcuauggaugaacuccacaacgagauucuggagcuugacgaaaaaguggacgaucugcgggccgacacaaucagcucucagauugagcucgcgguccugcuuagcaaugaagggaucaucaacuccgaggaugaacaucugcucgcucuggagcgcaagcugaaaaagaugcucggaccuucugccguggacauuggcaauggguguuucgagaccaagcacaaaugcaaccagacgugccuggauagaaucgccgcuggcaccuuuaaugucggagaguucagccuucccacauuugacucccugaacauuaccgccgcuagccucaaugaugacggccuggauaaccauacaauccugcuuuacuauucuaccgccgcguccagccucgccgugacgcugaugauugcuaucuucauuguuuacaugaucucucgggacaauguguccuguagcaucugccuguga

SEQ ID NO: 210924 - RNA, 1755 nt, Artificial Sequence
  derived and/or modified sequence opt5 from hemagglutinin__InfluenzaB__AHL91629
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugcuuuaacuguaccgaucucgacguugcccugggacgcccuaugugcgugggcauuacacccucugccaaggcuagcauccuucacgaagucagaccugugaccuccggguguuuccccaucaugcaugaucggacgaagauucgccaacugccuaaucuccugagaggauacgagaaaauccggcugucuacacagaacguuauugacgccgaaaaggcuccgggcggccccuauaaacucgggaccagcggauccugcccuaaugccacaagcaagucuggcuuuuucgcgaccauggccugggcugugccccgcgauaacaauaaaaccgccacaaacccucugacggucgaggugccccacaucuguaccaaggaagaggaccagauuacaguguggggguuucauuccgauaauaagacccagaugaaaaaccuuuacggagacagcaauccgcaaaaguucacaucuuccgcuaacggcaucaccacgcacuaugucagccagauugggggauuuccugaucagacagaggacggcggccugccccagucugggagaaucguuguggauuacauggugcaaaaaccuggaaagaccggcaccaucgucuaucagcgggggauucuccugccccagaaaguguggugcgccuccggacgcagcaagguuaucaaaggcucccuuccccugauuggggaagcggacugucuccacgagaaguacggaggccugaauaagucuaaaccuuauuacacaggcgaacaugccaaggcuaucgggaacugcccgauuugggugaaaacaccccugaagcucgccaacggaacaaaauacagaccucccgcuaagcugcuuaaggagcggggcuucuuuggggccaucgccggauuccuggagggcgggugggaaggcaugaucgcuggauggcacggcuauacgagccauggggcgcacggagucgccguggcugccgaucucaaauccacccaggaggccauuaauaagaucaccaaaaaccugaauagccuuucugaacuggagguuaagaaccuccaacgccuguccggcgcuauggacgaacugcacaaugagauucucgagcuggacgaaaaaguggaugaccuuagagccgauaccaucagcucucagauugagcuggcgguccuccugagcaacgaagggaucaucaauuccgaggacgaacaucuucuggcucucgagcggaagcugaagaaaaugcugggaccuucugccguggauauuggcaacggguguuuugagacaaagcacaaaugcaaucagaccugccucgaccgcaucgccgcuggcacguucaacgccggagaauuuagccugcccaccuucgauucccuuaauauuacagcugccagccugaacgacgauggccucgacaaucauaccauccugcuguacuauucuacagcggccuccagccuugcugucacccucaugauugccaucuucauuguguacaugaucucuagagauaacguuuccuguagcaucugccuguga

SEQ ID NO: 210925 - RNA, 1755 nt, Artificial Sequence; identical to SEQ ID NO: 210924
  derived and/or modified sequence opt5 from hemagglutinin__InfluenzaB__AHL91640

SEQ ID NO: 210926 - RNA, 1755 nt, Artificial Sequence; identical to SEQ ID NO: 209431
  derived and/or modified sequence opt5 from hemagglutinin__InfluenzaB__AHL91651

SEQ ID NO: 210927 - RNA, 1752 nt, Artificial Sequence
  derived and/or modified sequence opt5 from hemagglutinin__InfluenzaB__AHL91662
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaccgcuccgggcggccccuaucgccuggggacaagcggauccugcccuaacgccaccagcaagucuggcuucuuugcgaccauggccugggcugugcccagagacaauaacaaaacagccacgaauccucuuaccgucgaggugccccacaucuguacaaaggaagaggaucagauuaccguguggggguuccauuccgacaacaaaacacagaugaagaaucuguacggagauagcaacccgcaaaaguuuaccucuuccgcuaauggcaucacgacacacuaugucagccagauugggggauucccugaccagaccgaggauggcggccucccccagucugggcggaucguuguggacuacauggugcaaaaaccuggaaagaccggcacaaucgucuaucagcgcgggauucugcuuccccagaaaguguggugcgccuccggaagaagcaagguuaucaaaggcucccugccccucauuggggaagcggauugucugcacgagaaguacggaggccugaacaaaucuaagccuuauuacaccggcgaacaugccaaggcuaucgggaacugcccgauuugggugaaaacaccccucaagcuggccaauggaacgaaauaccggccucccgcuaaacuucugaaggagcgcggcuuuuucggggccaucgccggauuucucgagggcgggugggaaggcaugaucgcuggauggcacggcuauaccagccauggggcgcacggagucgccguggcugccgaccugaaguccacacaggaggccauuaacaagaucaccaaaaaucuuaacagccugucugaacucgagguuaagaaucugcaaagacuguccggcgcuauggaugaacuccacaacgagauucuggagcuugacgaaaaaguggacgaucugcgggccgacacaaucagcucucagauugagcucgcgguccugcuuagcaaugaagggaucaucaacuccgaggaugaacaucugcucgcucuggagcgcaagcugaaaaagaugcucggaccuucugccguggacauuggcaauggguguuucgagaccaagcacaaaugcaaccagacgugccuggauagaaucgccgcuggcaccuuuaaugccggagaguucagccuucccacauuugacucccugaacauuaccgcugccagccucaaugauggccuggacaaccauacaauccugcuuuacuauucuaccgcggccuccagccucgcugucacgcugaugauugccaucuucauuguguacaugaucucucgggauaauguuuccuguagcaucugccuguga

SEQ ID NO: 210928 - RNA, 1755 nt, Artificial Sequence; identical to SEQ ID NO: 209535
  derived and/or modified sequence opt5 from hemagglutinin__InfluenzaB__AHL91673

SEQ ID NO: 210929 - RNA, 1755 nt, Artificial Sequence
  derived and/or modified sequence opt5 from hemagglutinin__InfluenzaB__AHL91684
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaagucccauuucgcuaaucuuaaaggcacgaagacccgggggaaacugugucccacaugccucaacuguaccgaucuggacguugcccuuggacgcccuaugugcgugggcauuacacccucugccaaggcuagcauccugcacgaagucagaccugugaccuccggguguuuucccaucaugcaugaucggacgaagauucgccaacucccuaaucugcugagaggauacgagaaaauccggcucucuacacagaacguuauuaaugccgaaaaggcuccgggcggccccuaucgccuggggaccagcggauccugcccuaacgccacaagcaaaucuggcuucuuugcgaccauggccugggcugugcccagagacaauaacaagaccgccacaaauccucuuacgaucgaggucccccacauuuguaccaaagaagaggaucagaucacaguguggggguuccauuccgacaacaagacccagaugaagaaucuguacggagauagcaacccgcaaaaauuuacaucuuccgcuaauggcauuaccacgcacuaugugagccagaucgggggauucccugaccagacagaggauggcggccucccccagucugggcggaucgucguugacuacauggugcaaaagccuggaaaaaccggcaccauuguguaucagcgcgggauccugcuuccccagaaggucuggugcgccuccggaagaagcaaagugauuaagggcuuucugccccucaucggggaagcggauugucugcacgagaaauacggaggccugaacaaguccaagccuuauuacacaggcgaacaugccaaagcuauugggaacugcccgaucuggguuaagacaccccucaaacuggccaauggaaccaaguaccggccucccgcuaaacuucugaaggagcgcggcuucuuuggggccaucgccggauuccucgagggcgggugggaaggcaugauugcuggauggcacggcuauacgucucauggggcgcacggaguggccgucgcugccgaccuuaagagcacccaggaggccaucaacaaaauuacaaagaaucugaacucccugagcgaacucgaggugaaaaaucugcaaagacugucuggcgcuauggaugaacuccacaacgagauccuggagcuugacgaaaagguugacgaucugcgggccgacaccauuuccagccagaucgagcucgcggugcugcuuucuaaugaagggaucauuaacagcgaggaugaacaucugcucgcucuggagcgcaaacugaagaagaugcucggaccuuccgccgucgacaucggcaauggguguuuugagacaaaacacaagugcaaccagaccugccuggauagaauugccgcuggcacguucaaugccggagaauuuucucuucccaccuucgacagccugaacaucacagcugccucccucaaugaugacggccuggauaaccauaccauucugcuuuacuauagcacagcggccucuucccucgcugugacccugaugaucgccauuuucaucgucuacaugaucagccgggacaaugugucuuguuccauuugccuguga

SEQ ID NO: 210930 - RNA, 1755 nt, Artificial Sequence; identical to SEQ ID NO: 209431
  derived and/or modified sequence opt5 from hemagglutinin__InfluenzaB__AHL91695

SEQ ID NO: 210931 - RNA, 1755 nt, Artificial Sequence; identical to SEQ ID NO: 209535
  derived and/or modified sequence opt5 from hemagglutinin__InfluenzaB__AHL91706

SEQ ID NO: 210932 - RNA, 1758 nt, Artificial Sequence; identical to SEQ ID NO: 210003
  derived and/or modified sequence opt5 from hemagglutinin__InfluenzaB__AHL91717

SEQ ID NO: 210933 - RNA, 1758 nt, Artificial Sequence; identical to SEQ ID NO: 210003
  derived and/or modified sequence opt5 from hemagglutinin__InfluenzaB__AHL91728

SEQ ID NO: 210934 - RNA, 1758 nt, Artificial Sequence; identical to SEQ ID NO: 210003
  derived and/or modified sequence opt5 from hemagglutinin__InfluenzaB__AHL91739

SEQ ID NO: 210935 - RNA, 1755 nt, Artificial Sequence; identical to SEQ ID NO: 209535
  derived and/or modified sequence opt5 from hemagglutinin__InfluenzaB__AHL91750

SEQ ID NO: 210936 - RNA, 1758 nt, Artificial Sequence; identical to SEQ ID NO: 210003
  derived and/or modified sequence opt5 from hemagglutinin__InfluenzaB__AHL91761

SEQ ID NO: 210937 - RNA, 1758 nt, Artificial Sequence
  derived and/or modified sequence opt5 from hemagglutinin__InfluenzaB__AHL91772
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccaaagucagcauccugcacgaagugagaccuguuacauccggguguuuucccaucaugcaugaucggaccaagauucgccaacucccuaaccugcugagaggauacgagcacauccggcucucuacgcauaaugugauuaacgccgaaaaagcuccgggcggccccuauaagaucgggacaagcggauccugcccuaauauuaccaacggcaauggguucuuugccacaauggcuugggccguccccaaaaacgacaauaacaagaccgcgaccaauagccugacaaucgaggugccuuacauuuguacggaaggagaggaucagaucaccguguggggcuuccacucugacaacgagacacagauggccaaacuuuauggggauuccaaaccccagaaguuuaccagcucugcuaacggagucacaacccacuacguuucccaaaucggcggcuucccgaaucagacggaagacgggggacugccucagagcggccgcauugugguggauuauaugguccagaaaucugggaagacaggaaccaucaccuaccaaagaggcauucuccugccccagaaaguguggugcgccuccgggcggagcaagguuaucaaaggaucccuuccucugauuggcgaggcugacugucuccaugaaaaguauggcgggcugaacaagucuaaacccuacuacacaggagagcacgccaaggcgaucggcaauugccccaucugggugaaaaccccucugaagcucgccaacgggacaaaauaucgcccgcccgcuaagcugcuuaaggagagaggauuuuucggcgccauugcuggguuucuggaaggcggaugggagggcaugaucgccggguggcauggauacacgagccacggcgcccacggggucgcuguggcggccgaucucaaauccacccaggaagcuauuaauaagaucacaaagaaccugaauagccuuucugagcuggaaguuaagaaccuccagcggcuguccggagccauggacgagcugcauaaugagauucucgaacuggaugagaaaguggacgaccuucgcgccgauaccaucagcucucaaaucgaacuggcuguccuccugagcaacgagggcauuaucaauuccgaagacgagcaccuucuggcccucgagagaaagcugaagaaaaugcuggggccuucugcgguggaaauuggcaacggauguuucgagacaaagcauaaaugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauugccaucuucgugguuuauauggugucucgcgauaacgucuccuguagcaucugccuguga

SEQ ID NO: 210938 - RNA, 1758 nt, Artificial Sequence; identical to SEQ ID NO: 210937
  derived and/or modified sequence opt5 from hemagglutinin__InfluenzaB__AHL91783

SEQ ID NO: 210939 - RNA, 1758 nt, Artificial Sequence; identical to SEQ ID NO: 210937
  derived and/or modified sequence opt5 from hemagglutinin__InfluenzaB__AHL91794

SEQ ID NO: 210940 - RNA, 1758 nt, Artificial Sequence
  derived and/or modified sequence opt5 from hemagglutinin__InfluenzaB__AHL91805
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugcuuuaacuguacagaucucgacguggcucugggacgcccuaagugcaccggcaauauucccucugccgaagucagcauccuucacgaggugagaccuguuacauccggguguuuccccaucaugcaugaucggaccaaaauucgccaacugccuaaccuccugagaggauacgaacacauccggcugucuacgcauaaugugauuaacgccgagaaggcuccgggcggccccuauaaaaucgggacaagcggauccugcccuaaugucaccaacggcaauggguuuuucgccacaauggcuugggccgugcccaagaacgacaauaacaaaaccgcgaccaauagccucacaauugaagugccuuacaucuguacggagggagaggaucagauuaccgucuggggcuuucacucugacaacgaaacacagauggccaagcuguauggggauuccaagccccagaaauucaccagcucugcuaacggaguuacaacccacuacgugucccaaaucggcggcuuuccgaaucagacggaggacgggggacuuccucagagcggccgcaucguggucgauuauauggugcagaagucugggaaaacaggaaccauuaccuaccaaagaggcauccugcucccccagaagguuuggugcgccuccgggcggagcaaagugauuaagggaucccugccucuuaucggcgaagcugacugucugcaugagaaauauggcgggcucaacaagucuaagcccuacuacacaggagagcacgccaaagcgauuggcaauugccccaucugggucaagaccccucugaaacuggccaacgggacaaaguaucgcccgcccgcuaaacuccugaaggaaagaggauucuuuggcgccaucgcuggguuccuugagggcggaugggaaggcaugauugccggguggcauggauacacgagccacggcgcccacgggguggcuguugcggccgaucugaaguccacccaggaggcuaucaauaaaauuacaaagaaccucaauagccugucugaacuugaggugaaaaaccugcagcggcucuccggagccauggacgagcugcauaaugaaauccuggagcucgaugaaaaggucgacgaccugcgcgccgauaccauuagcucucaaaucgagcuugcugugcugcucagcaacgaaggcaucauuaauuccgaggacgagcaucugcuugcccuggaaagaaaacucaagaagaugcuggggccuucugcggucgagaucggcaacggauguuuugaaacaaaacacaagugcaaucagaccugccuggaucggauugcugccggcacguucgacgccggggaguuuagccuccccaccuucgauucccugaacaucacagcugccagccuuaaugacgauggacuggacaaccacaccauucuccuguauuacucuacagcugccuccagccuggcggugacccuuaugaucgccauuuucguuguguauauggucucucgcgauaacguguccuguagcaucugccucuga

SEQ ID NO: 210941 - RNA, 1758 nt, Artificial Sequence; identical to SEQ ID NO: 209443
  derived and/or modified sequence opt5 from hemagglutinin__InfluenzaB__AHL91816

SEQ ID NO: 210942 - RNA, 1758 nt, Artificial Sequence; identical to SEQ ID NO: 209443
  derived and/or modified sequence opt5 from hemagglutinin__InfluenzaB__AHL91827

SEQ ID NO: 210943 - RNA, 1755 nt, Artificial Sequence; identical to SEQ ID NO: 210050
  derived and/or modified sequence opt5 from hemagglutinin__InfluenzaB__AHL91838

SEQ ID NO: 210944 - RNA, 1755 nt, Artificial Sequence
  derived and/or modified sequence opt5 from hemagglutinin__InfluenzaB__AHL91849
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagcucggccugugaccuccggguguuuucccaucaugcacgaccgcacgaagaucagacaacucccuaaucugcugcggggauaugagaacauucgccucucuacacagaauguuaucgaugccgaaaacgcuccgggcggccccuacagacuggggaccagcggauccugcccuaaugccacaagcaagucuggcuucuuugcgaccauggccugggcugugcccaaagacaacaauaagaacgccaccaauccucuuacagucgaggugcccuauauuuguaaagaaggggaggaucagaucacgguguggggauuccauuccgacaacaagacccagaugaaaaaucuguacggcgauagcaacccgcaaaaguuuacaucuuccgcuaacggggucaccacacacuauguuagccagauuucuggauucccugcccagaccgaggacggcggccucccccaguccgggcggaucgugguggauuacaugguccaaaagccucgcaaaacgggaacaauuguguaucagagaggcguucugcuuccccagaagguguggugcgcgagcgggcgguccaaagucaucaagggaucucugccccucaucggcgaagccgacugucugcaugagaaauacgggggacugaauaagagcaaaccuuacuauaccggcgaacacgcuaaggccauuggcaacugcccgaucugggugaagacaccccucaaacuggcuaaugggaccaaguaccgcccucccgccaaacuucugaaggagagaggauuuuucggcgccauugcuggguuucucgagggaggcugggaagggaugaucgcgggcuggcacggauauaccucccauggcgcccacgggguugcuguggccgccgaucugaaaagcacacaggaggcuauuaacaagaucacgaagaaucuuaacucucuguccgaacucgaggucaaaaaucugcaacggcugagcggagccauggacgaacuccauaacgagauccuggagcuugacgaaaagguggaugaccugcgcgcggauaccauuucuagccagaucgagcucgcuguccugcuuuccaaugaaggcauuaucaacucugaggacgaacaucugcucgcccuggagagaaaacugaagaaaaugcucgggccuagcgccguggauauuggaaauggcuguuucgagacaaagcacaagugcaaccagaccugccuggaccggaucgcugccgggacauuuaaugcuggcgaguucucccuucccaccuuugauagccugaacaucacggccgcgucucucaaugacgauggacuggacaaccacaccauucugcuuuacuauuccacagccgcuagcucucucgccguuacccugaugcuggcuaucuucauuguguacauggucuccagagauaacgugagcuguuccaucugccucuga

SEQ ID NO: 210945 - RNA, 1755 nt, Artificial Sequence
  derived and/or modified sequence opt5 from hemagglutinin__InfluenzaB__AHL91860
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggagauucccuauaucuguacggaaggggaggaucagauuaccguguggggauuccauuccgacaauaagacacagaugaaaaaccuguacggcgauagcaauccgcaaaaguuuaccucuuccgccaacggggucacaacccacuauguuagccagaucggaggcuucccugaccagacggaggauggcgggcucccccagucuggacggauugugguggacuacaugaugcaaaagccuggcaaaacagggaccaucgucuaucagcgcggagugcugcuuccccagaagguuuggugcgcuuccggcagaagcaaagugaucaaggggucccugccccucauuggagaagccgauugucugcaugagaaauacggcggccugaacaagucuaaaccuuacuauaccggggaacacgcgaaggccaucggaaauugcccgauuugggucaagacaccccucaaacuggcuaacggcaccaaguaccggccucccgccaaacuucugaaggagcgcggguuuuucggagcuaucgccggcuuucucgaagggggcugggagggaaugauugccggcuggcacggguauacaagccauggagcucacggcguggcgguugccgcugaccugaaauccacgcaggaggccaucaauaagaucaccaagaaccuuaauagccugucugaacucgaggugaaaaaccugcaaagacuguccggggccauggacgaacuccauaaugagauucuggagcuugaugaaaaggucgacgaucugcgggcugacacaaucagcucucagauugagcucgccgugcugcuuagcaacgaaggaaucauuaauuccgaggaugaacaucugcucgcgcuggagcgcaaacugaagaaaaugcucggcccuucugcugucgagaucgggaacggcuguuucgaaaccaagcacaagugcaaucagacaugccuggacagaaucgccgccggaaccuuuaacgcuggcgaguucagccuucccacguuugauucccugaauauuaccgccgcuagccucaacgacgaugggcuggacaaucacgccauccugcuuuacuauucuacagcggccuccagccucgcugugacccugaugcuggccauuuucaucguuuacauggugucucgggauaacgucuccuguagcauuugccucuga

SEQ ID NO: 210946 - RNA, 1755 nt, Artificial Sequence
  derived and/or modified sequence opt5 from hemagglutinin__InfluenzaB__AHL91871
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggagauucccuauaucuguacggaaggggaggaucagauuaccguguggggauuccauuccgacaauaagacacagaugaaaaaccuguacggcgauagcaauccgcaaaaguuuaccucuuccgccaacggggucacaacccacuauguuagccagaucggaggcuucccugaccagacggaggauggcgggcucccccagucuggacggauugugguggacuacaugaugcaaaagccuggcaaaacagggaccaucgucuaucagcgcggagugcugcuuccccagaagguuuggugcgcuuccggcagaagcaaagugaucaaggggucccugccccucauuggagaagccgauugucugcaugagaaauacggcggccugaacaagucuaaaccuuacuauaccggggaacacgcgaaggccaucggaaauugcccgauuugggucaagacaccccucaaacuggcuaacggcaccaaguaccggccucccgccaaacuucugaaggagcgcggguuuuucggagcuaucgccggcuuucucgaagggggcugggagggaaugauugccggcuggcacggguauacaagccauggagcucacggcguggcgguugccgcugaccugaaauccacgcaggaggccaucaauaagaucaccaagaaccuuaauagccugucugaacucgaggugaaaaaccugcaaagacuguccggggccauggacgaacuccauaaugagauucuggagcuugaugaaaaggucgacgaucugcgggcugacacaaucagcucucagauugagcucgccgugcugcuuagcaacgaaggaaucauuaauuccgaggaugaacaucugcucgcgcuggagcgcaaacugaagaaaaugcucggcccuucugcugucgagaucgggaacggcuguuucgaaaccaagcacaagugcaaucagacaugccuggacagaaucgccgccggaaccuuuaacgcuggcgaguucagccuucccacguuugauucccugaauauuaccgccgcuagccucaacgacgaugggcuggacaaucacacaauccugcuuuacuauucuaccgccgcguccagccucgccgugacacugaugcuggcuauuuucaucguuuacauggugucucgggauaacgucuccuguagcauuugccucuga

SEQ ID NO: 210947 - RNA, 1755 nt, Artificial Sequence; identical to SEQ ID NO: 209450
  derived and/or modified sequence opt5 from hemagglutinin__InfluenzaB__AHL91882

SEQ ID NO: 210948 - RNA, 1755 nt, Artificial Sequence
  derived and/or modified sequence opt5 from hemagglutinin__InfluenzaB__AHL91904
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaagcaaaucuggcuucuuugcgaccauggccugggcugucccuaaggacaauaacaaaaaugccaccaacccccuuacaguggaggugccuuauauuuguacggaaggggaggaucagaucaccgucuggggauuccauuccgacaauaagacacagaugaaaaaccuguacggcgauagcaauccccaaaaguuuaccucuuccgcuaacgggguuacaacccacuaugugagccagauuggaggcuucccggaccagacggaggauggcgggcucccucagucuggacggaucguggucgacuacaugaugcaaaagcauggcaaaacagggaccauuguguaucagcgcggaguucugcuuccccagaagguguggugcgccuccggcagaagcaaagucaucaaggggucccugccucucaucggagaagcggauugucugcacgagaaauacggcggccugaacaagucuaaacccuacuauaccggggaacacgccaaggcuauuggaaauugccccaucugggugaagacaccucucaaacuggccaacggcaccaaguaccggccgcccgcuaaacuucugaaggagcgcggguuuuucggagccauugccggcuuucucgaagggggcugggaaggaaugaucgcuggcuggcauggguauacaagccacggagcgcauggcguugccguggcugccgaccugaaauccacgcaggaggccauuaauaagaucaccaagaaccuuaauagccugucugaacucgaggucaaaaaccugcaaagacuguccggggcuauggacgaacuccacaaugagauccuggagcuugaugaaaagguggacgaucugcgggccgacacaauuagcucucagaucgagcucgcgguccugcuuagcaacgaaggaauuaucaauuccgaggaugaacaucugcucgcucuggagcgcaaacugaagaaaaugcucggcccuucugccguggacauugggaacggcuguuucgagaccaagcacaagugcaaucagacaugccuggauagaaucgccgcuggaaccuuuaacgccggcgaguucagccuucccacguuugacucccugaauaucaccgcugccagccucaacgaugacgggcuggauaaucacacaauucugcuuuacuauucuaccgcggccuccagccucgcuguuacacugaugcuggccaucuucauuguguacauggucucucgggacaacguguccuguagcaucugccucuga

SEQ ID NO: 210949 - RNA, 1755 nt, Artificial Sequence
  derived and/or modified sequence opt5 from hemagglutinin__InfluenzaB__AHL91915
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauuauaaaaacgcuaccaauccucuuacaguggaggugcccuacauuuguacggaaggggaggaucagaucaccgucuggggauuccauuccgacaacaagacacagaugaaaaaucuguauggcgauagcaacccgcaaaaguuuaccucuuccgccaaugggguuacaacccacuacgugagccagauuggaggcuucccugaccagacggaggauggcgggcucccccagucuggacggaucguggucgacuauaugaugcaaaagccuggcaaaacagggaccauuguguaccagcgcggaguucugcuuccccagaagguguggugcgcuuccggcagaagcaaagucaucaaggggucccugccccucaucggagaagccgauugucugcaugagaaauacggcggccugaacaagucuaaaccuuauuacaccggggaacacgcgaaggccauuggaaacugcccgaucugggugaagacaccccucaaacuggcuaauggcaccaaguaucggccucccgccaaacuucugaaggagcgcggguuuuucggagcuauugccggcuuucucgaagggggcugggaaggaaugaucgccggcuggcacggguacacaagccauggagcucacggcguugcgguggccgcugaccugaaauccacgcaggaggccauuaacaagaucaccaagaaucuuaacagccugucugaacucgaggucaaaaaucugcaaagacuguccggggccauggacgaacuccauaacgagauccuggagcuugaugaaaagguggacgaucugcgggcugacacaauuagcucucagaucgagcucgccguccugcuuagcaaugaaggaauuaucaacuccgaggaugaacaucugcucgcgcuggagcgcaaacugaagaaaaugcucggcccuucugcuguggacauugggaauggcuguuucgagaccaagcacaagugcaaccagacaugccuggauagaaucgccgccggaaccuuuaaugcuggcgaguucagccuucccacguuugacucccugaacaucaccgccgcuagccucaaugaugacgggcuggauaaccacacaauucugcuuuauuacucuaccgccgcguccagccucgccguuacacugaugcuggcuaucuucauuguguauauggucucucgggacaauguguccuguagcaucugccucuga

SEQ ID NO: 210950 - RNA, 1755 nt, Artificial Sequence; identical to SEQ ID NO: 210048
  derived and/or modified sequence opt5 from hemagglutinin__InfluenzaB__AHL91926

SEQ ID NO: 210951 - RNA, 1755 nt, Artificial Sequence; identical to SEQ ID NO: 210623
  derived and/or modified sequence opt5 from hemagglutinin__InfluenzaB__AHL91937

SEQ ID NO: 210952 - RNA, 1755 nt, Artificial Sequence; identical to SEQ ID NO: 209450
  derived and/or modified sequence opt5 from hemagglutinin__InfluenzaB__AHL91948

SEQ ID NO: 210953 - RNA, 1758 nt, Artificial Sequence
  derived and/or modified sequence opt5 from hemagglutinin__InfluenzaB__AHL91959
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcggcuguccggagccauggacgagcugcauaaugaaauucucgagcuggaugaaaagguggacgaccuucgcgccgauaccaucagcucucaaaucgagcuggcuguccuccugagcaacgaaggcauuaucaauuccgaggacgagcaccuucuggcccucgaaagaaaacugaagaagaugcuggggccuucugcgguggagauuggcaacggauguuucgaaacaaaacauaagugcaaucagaccugccucgaucggaucgcugccggcacguuugacgccggggaguucagccugcccaccuuugauucccuuaacauuacagcugccagcuucaaugacgauggacuggacaaccacaccauccuccuguauuacucuacagcugccuccagccuggcggucacccuuaugauugccaucuucgugguuuauauggugucucgcgauaacgucuccuguagcaucugccucuga

SEQ ID NO: 210954 - RNA, 1758 nt, Artificial Sequence; identical to SEQ ID NO: 209662
  derived and/or modified sequence opt5 from hemagglutinin__InfluenzaB__AHL91970

SEQ ID NO: 210955 - RNA, 1755 nt, Artificial Sequence
  derived and/or modified sequence opt5 from hemagglutinin__InfluenzaB__AHL91991
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucgcuaaucugcugcggggauaugagaacauucgccucucuacacagaaugugaucgaugccgaaaaggcuccuggcggcccguacagacuggggaccagcggauccugccccaacgccacaaauaaaagcggcuucuuugcgaccauggccugggcugucccuaaggacaacaauaaaaacgccaccaauccccuuacaguggaggugccuuauauuuguacggaaggggaggaucagaucaccgucuggggauuccauucugacaacaagacacagaugaaaaaucuguacggcgauuccaacccccaaaaguuuaccagcucugcuaacgggguuacaacccacuaugugucccagauuggaggcuucccggaccagacggaggauggcgggcucccucagagcggacggaucguggucgacuacaugaugcaaaagcccggcaaaacagggaccauuguguaucagcgcggaguucugcuuccucagaagguguggugcgccucuggcagauccaaagucaucaaggggagccugccccucaucggagaagcggauugucugcaugagaaauacggcggccugaauaaguccaaacccuacuauaccggggaacacgccaaggcuauuggaaacugcccuaucugggugaagacaccgcucaaacuggccaauggcaccaaguaccggcccccugcuaaacuucugaaggagcgcggguuuuucggagccauugccggcuuucucgaagggggcugggaaggaaugaucgcuggcuggcacggguauacaucucauggagcgcacggcguugccguggcugccgaccugaaaagcacgcaggaggccauuaacaagaucaccaagaaucuuaacucccugagcgaacucgaggucaaaaaucugcaaagacugucuggggcuauggacgaacuccauaacgagauccuggagcuugaugaaaagguggacgaucugcgggccgacacaauuuccagccagaucgagcucgcgguccugcuuucuaaugaaggaauuaucaacagcgaggaugaacaucugcucgcucuggagcgcaaacugaagaaaaugcucggccccuccgccguggacauugggaauggcuguuucgagaccaagcacaagugcaaccagacaugccuggauagaaucgccgcuggaaccuuuaaugccggcgaguucucucuuccuacguuugacagccugaacaucaccgcugccucccucaaugaugacgggcuggauaaccacacaauucugcuuuacuauagcaccgcggccucuucccucgcuguuacacugaugcuggccaucuucauuguguacauggucagccgggacaacgugucuuguuccaucugccucuga

SEQ ID NO: 210956 - RNA, 1758 nt, Artificial Sequence; identical to SEQ ID NO: 209538
  derived and/or modified sequence opt5 from hemagglutinin__InfluenzaB__AHL92002

SEQ ID NO: 210957 - RNA, 1758 nt, Artificial Sequence; identical to SEQ ID NO: 209538
  derived and/or modified sequence opt5 from hemagglutinin__InfluenzaB__AHL92013

SEQ ID NO: 210958 - RNA, 1758 nt, Artificial Sequence; identical to SEQ ID NO: 209538
  derived and/or modified sequence opt5 from hemagglutinin__InfluenzaB__AHL92024

SEQ ID NO: 210959 - RNA, 1758 nt, Artificial Sequence; identical to SEQ ID NO: 209538
  derived and/or modified sequence opt5 from hemagglutinin__InfluenzaB__AHL92035

SEQ ID NO: 210960 - RNA, 1758 nt, Artificial Sequence; identical to SEQ ID NO: 209538
  derived and/or modified sequence opt5 from hemagglutinin__InfluenzaB__AHL92046

SEQ ID NO: 210961 - RNA, 1758 nt, Artificial Sequence; identical to SEQ ID NO: 209538
  derived and/or modified sequence opt5 from hemagglutinin__InfluenzaB__AHL92057

SEQ ID NO: 210962 - RNA, 1758 nt, Artificial Sequence
  derived and/or modified sequence opt5 from hemagglutinin__InfluenzaB__AHL92068
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacauuaccaauggcaacggguucuuugccacaauggcuugggccguccccaagaaugacaacaauaaaaccgcgaccaacagccugacaaucgaagugccuuacauuuguacggagggagaggaucagaucaccguguggggcuuccacucugacaacgaaacacagauggccaaacuuuauggggauuccaagccccagaaguuuaccagcucugcuaauggagucacaacccacuacguuucccaagugggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcugccggcacguuugacgccggggaguucagccugcccaccuuugauucccuuaauaucacagcugccagccugaacgacgauggacucgacaaccacaccauucugcuguauuacucuacagcugccuccagccuugcggugacccucaugaucgccauuuucguuguguauauggucucuagagauaauguguccuguagcaucugccuguga

SEQ ID NO: 210963 - RNA, 1758 nt, Artificial Sequence
  derived and/or modified sequence opt5 from hemagglutinin__InfluenzaB__AHL92079
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacauuaccaauggcaacggguucuuugccacaauggcuugggccguccccaagaaugacaacaauaaaaccgcgaccaacagccugacaaucgaagugccuuacauuuguacggagggagaggaucagaucaccguguggggcuuccacucugacaacgaaacacagauggccaaacuuuauggggauuccaagccccagaaguuuaccagcucugcuaauggagucacaacccacuacguuucccaaaucggcggcuucccgaaccagacggaggacgggggacugccucagagcggcagaauugugguggauuauaugguccagaagucugggaaaacaggaaccaucaccuaccaacggggcauucuccugccccagaagguguggugcgccuccgggcgcagcaaaguuaucaagggaucccuuccucugauuggcgaagcugacugucuccaugagaaauauggcgggcugaauaagucuaaacccuacuacacaggagagcacgccaaggcgaucggcaacugccccaucugggugaagaccccucugaaacucgccaaugggacaaaguauagaccgcccgcuaaacugcuuaaggaacggggauuuuucggcgccauugcuggguuucuggagggcggaugggaaggcaugaucgccggguggcauggauacacgagccacggcgcccacggggucgcuguggcggccgaucucaaauccacccaggaggcuauuaacaagaucacaaagaaucugaacagccuuucugaacuggagguuaaaaaucuccagcgccuguccggagccauggacgagcugcauaacgaaauucucgagcuggaugaaaagguggacgaccuuagagccgauaccaucagcucucaaaucgagcuggcuguccuccugagcaaugaaggcauuaucaacuccgaggacgagcaccuucuggcccucgaacggaaacugaagaaaaugcuggggccuucugcgguggagauuggcaauggauguuucgaaacaaagcauaagugcaaccagaccugccucgaucgcaucgcugccggcacguuugacgccggggaguucagccugcccaccuuugauucccuuaauauuacagcugccagccugaacgacgauggacucgacaaccacaccauccugcuguauuacucuacagcugccuccagccuugcggucacccucaugauugccaucuucgugguuuauauggugucuagagauaaugucuccuguagcaucugccuguga

SEQ ID NO: 210964 - RNA, 1758 nt, Artificial Sequence; identical to SEQ ID NO: 210963
  derived and/or modified sequence opt5 from hemagglutinin__InfluenzaB__AHL92090

SEQ ID NO: 210965 - RNA, 1758 nt, Artificial Sequence; identical to SEQ ID NO: 209538
  derived and/or modified sequence opt5 from hemagglutinin__InfluenzaB__AHL92101

SEQ ID NO: 210966 - RNA, 1755 nt, Artificial Sequence; identical to SEQ ID NO: 209591
  derived and/or modified sequence opt5 from hemagglutinin__InfluenzaB__AHL92112

SEQ ID NO: 210967 - RNA, 1758 nt, Artificial Sequence; identical to SEQ ID NO: 209538
  derived and/or modified sequence opt5 from hemagglutinin__InfluenzaB__AHL92123

SEQ ID NO: 210968 - RNA, 1758 nt, Artificial Sequence; identical to SEQ ID NO: 210963
  derived and/or modified sequence opt5 from hemagglutinin__InfluenzaB__AHL92134

SEQ ID NO: 210969 - RNA, 1758 nt, Artificial Sequence; identical to SEQ ID NO: 210963
  derived and/or modified sequence opt5 from hemagglutinin__InfluenzaB__AHL92145

SEQ ID NO: 210970 - RNA, 1758 nt, Artificial Sequence; identical to SEQ ID NO: 209538
  derived and/or modified sequence opt5 from hemagglutinin__InfluenzaB__AHL92156

SEQ ID NO: 210971 - RNA, 1758 nt, Artificial Sequence; identical to SEQ ID NO: 210963
  derived and/or modified sequence opt5 from hemagglutinin__InfluenzaB__AHL92167

SEQ ID NO: 210972 - RNA, 1758 nt, Artificial Sequence; identical to SEQ ID NO: 209538
  derived and/or modified sequence opt5 from hemagglutinin__InfluenzaB__AHL92178

SEQ ID NO: 210973 - RNA, 1758 nt, Artificial Sequence; identical to SEQ ID NO: 209538
  derived and/or modified sequence opt5 from hemagglutinin__InfluenzaB__AHL92189

SEQ ID NO: 210974 - RNA, 1755 nt, Artificial Sequence; identical to SEQ ID NO: 209591
  derived and/or modified sequence opt5 from hemagglutinin__InfluenzaB__AHL92200

SEQ ID NO: 210975 - RNA, 1758 nt, Artificial Sequence; identical to SEQ ID NO: 209538
  derived and/or modified sequence opt5 from hemagglutinin__InfluenzaB__AHL92211

SEQ ID NO: 210976 - RNA, 1758 nt, Artificial Sequence; identical to SEQ ID NO: 209538
  derived and/or modified sequence opt5 from hemagglutinin__InfluenzaB__AHL92222

SEQ ID NO: 210977 - RNA, 1755 nt, Artificial Sequence; identical to SEQ ID NO: 210853
  derived and/or modified sequence opt5 from hemagglutinin__InfluenzaB__AHL92233

SEQ ID NO: 210978 - RNA, 1758 nt, Artificial Sequence; identical to SEQ ID NO: 210963
  derived and/or modified sequence opt5 from hemagglutinin__InfluenzaB__AHL92244

SEQ ID NO: 210979 - RNA, 1758 nt, Artificial Sequence; identical to SEQ ID NO: 209538
  derived and/or modified sequence opt5 from hemagglutinin__InfluenzaB__AHL92255

SEQ ID NO: 210980 - RNA, 1758 nt, Artificial Sequence; identical to SEQ ID NO: 209538
  derived and/or modified sequence opt5 from hemagglutinin__InfluenzaB__AHL92266

SEQ ID NO: 210981 - RNA, 1758 nt, Artificial Sequence
  derived and/or modified sequence opt5 from hemagglutinin__InfluenzaB__AHL92277
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaaacaggaaccauuaccuaccaacggggcauccuccugccccagaagguuuggugcgccuccgggcgcagcaaagugauuaagggaucccuuccucugaucggcgaagcugacugucuccaugagaaauauggcgggcugaauaagucuaaacccuacuacacaggagagcacgccaaggcgauuggcaacugccccaucugggucaagaccccucugaaacucgccaaugggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaucucaaauccacccaggaggcuaucaacaagauuacaaagaaucugaacagccuuucugaacuggaggugaaaaaucuccagcgccuguccggagccauggacgagcugcauaacgaaauccucgagcuggaugaaaaggucgacgaccuuagagccgauaccauuagcucucaaaucgagcuggcugugcuccugagcaaugaaggcaucauuaacuccgaggacgagcaccuucuggcccucgaacggaaacugaagaaaaugcuggggccuucugcggucgagaucggcaauggauguuucgaaacaaagcauaagugcaaccagaccugccucgaucgcauugcuacgggcaccuuugacgccggggaguucagccugcccacauuugauucccuuaauaucaccgccgcuagccugaacgacgauggacucgacaaccacacaauucugcuguauuacucuaccgccgcuuccagccuugccgugacgcucaugaucgcgauuuucguuguguauauggucucuagagauaauguguccuguagcaucugccuguga

SEQ ID NO: 210982 - RNA, 1758 nt, Artificial Sequence; identical to SEQ ID NO: 209538
  derived and/or modified sequence opt5 from hemagglutinin__InfluenzaB__AHL92288

SEQ ID NO: 210983 - RNA, 1758 nt, Artificial Sequence; identical to SEQ ID NO: 209538
  derived and/or modified sequence opt5 from hemagglutinin__InfluenzaB__AHL92299

SEQ ID NO: 210984 - RNA, 1755 nt, Artificial Sequence; identical to SEQ ID NO: 210656
  derived and/or modified sequence opt5 from hemagglutinin__InfluenzaB__AHL92310

SEQ ID NO: 210985 - RNA, 1755 nt, Artificial Sequence; identical to SEQ ID NO: 209591
  derived and/or modified sequence opt5 from hemagglutinin__InfluenzaB__AHL92321

SEQ ID NO: 210986 - RNA, 1755 nt, Artificial Sequence; identical to SEQ ID NO: 209591
  derived and/or modified sequence opt5 from hemagglutinin__InfluenzaB__AHL92332

SEQ ID NO: 210987 - RNA, 1755 nt, Artificial Sequence
  derived and/or modified sequence opt5 from hemagglutinin__InfluenzaB__AHL92354
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcauuacccccucugccaaagccagcauccugcaugaagugcggccuguuacauccggguguuuucccaucaugcacgaccgcaccaagauuagacaacucgcuaaucugcugcggggauaugagaacauccgccucucuacgcagaauguggucgaugccgaaaaggcuccuggcggcccguacagacuggggacaagcggauccugccccaacgccaccagcaaaucuggcuucuuugcgacaauggccugggcugugccuaaggacaauaacaaaaaugccaccaacccccuuaccguggaggucccuuauauuuguacagaaggggaggaucagaucacgguuuggggauuccauuccgacaauaagacccagaugaaaaaccuguacggcgauagcaauccccaaaaguuuacaucuuccgcuaacggggugaccacacacuaugugagccagauuggaggcuucccggaccagaccgaggauggcgggcucccucagucuggacggaucgucguggacuacaugaugcaaaagcccggcaaaacggggacaauuguuuaucagcgcggagugcugcuuccucagaaggucuggugcgccuccggcagaagcaaagugaucaaggggucccugccccucaucggagaagcggauugucugcaugagaaauacggcggccugaacaagucuaaacccuacuauaccggggaacacgccaaggcuauuggaaauugcccuaucuggguuaagaccccgcucaaacuggccaacggcacaaaguaccggcccccugcuaaacuucugaaggagcgcggguuuuucggagccauugccggcuuucucgaagggggcugggaaggaaugaucgcuggcuggcacggguauaccagccauggagcgcacggcguggccgucgcugccgaccugaaauccacacaggaggccauuaauaagaucacgaagaaccuuaauagccugucugaacucgaggugaaaaaccugcaaagacuguccggggcuauggacgaacuccauaaugagauccuggagcuugaugaaaaggucgacgaucugcgggccgacaccauuagcucucagaucgagcucgcggugcugcuuagcaacgaaggaauuaucaauuccgaggaugaacaucugcucgcucuggagcgcaaacugaagaaaaugcucggccccucugccguugacauugggaacggcuguuucgagacaaagcacaagugcaaucagaccugccuggauagaaucgccgcuggaacauuuaacgccggcgaguucagccuuccuaccuuugacucccugaauaucacggcugccagccucaacgaugacgggcuggauaaucacaccauucugcuuuacuauucuacagcggccuccagccucgcugugacccugaugcuggccaucuucauugucuacauggugucucgggacaacguuuccuguagcaucugccucuga

SEQ ID NO: 210988 - RNA, 1755 nt, Artificial Sequence; identical to SEQ ID NO: 210987
  derived and/or modified sequence opt5 from hemagglutinin__InfluenzaB__AHL92365

SEQ ID NO: 210989 - RNA, 1755 nt, Artificial Sequence; identical to SEQ ID NO: 209844
  derived and/or modified sequence opt5 from hemagglutinin__InfluenzaB__AHL92376

SEQ ID NO: 210990 - RNA, 1755 nt, Artificial Sequence; identical to SEQ ID NO: 209844
  derived and/or modified sequence opt5 from hemagglutinin__InfluenzaB__AHL92387

SEQ ID NO: 210991 - RNA, 1755 nt, Artificial Sequence; identical to SEQ ID NO: 209844
  derived and/or modified sequence opt5 from hemagglutinin__InfluenzaB__AHL92398

SEQ ID NO: 210992 - RNA, 1755 nt, Artificial Sequence; identical to SEQ ID NO: 209844
  derived and/or modified sequence opt5 from hemagglutinin__InfluenzaB__AHL92409

SEQ ID NO: 210993 - RNA, 1755 nt, Artificial Sequence; identical to SEQ ID NO: 209844
  derived and/or modified sequence opt5 from hemagglutinin__InfluenzaB__AHL92420

SEQ ID NO: 210994 - RNA, 1755 nt, Artificial Sequence; identical to SEQ ID NO: 209591
  derived and/or modified sequence opt5 from hemagglutinin__InfluenzaB__AHL92431

SEQ ID NO: 210995 - RNA, 1755 nt, Artificial Sequence; identical to SEQ ID NO: 209844
  derived and/or modified sequence opt5 from hemagglutinin__InfluenzaB__AHL92442

SEQ ID NO: 210996 - RNA, 1755 nt, Artificial Sequence; identical to SEQ ID NO: 209844
  derived and/or modified sequence opt5 from hemagglutinin__InfluenzaB__AHL92453

SEQ ID NO: 210997 - RNA, 1755 nt, Artificial Sequence; identical to SEQ ID NO: 209844
  derived and/or modified sequence opt5 from hemagglutinin__InfluenzaB__AHL92464

SEQ ID NO: 210998 - RNA, 1755 nt, Artificial Sequence
  derived and/or modified sequence opt5 from hemagglutinin__InfluenzaB__AHL92475
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaaagacugucuggcgccauggaugaacuccauaacgagauucuggagcuugacgaaaagguggaugaccugcgggcugauacaaucuccagccagauugagcucgccguccugcuuucuaaugaagggaucauuaacagcgaggacgaacaucugcucgcgcuggagcgcaaacugaagaaaaugcucggaccuuccgcuguggauaucggcaauggguguuucgagaccaagcacaagugcaaccaggccugccuggacagaaucgccgcuggcacauuuaaugccggagaguucucucuucccaccuuugauagccugaacauuacggcugccucccucaaugacgauggccuggacaaccacaccauccugcuuuauuacagcacagcggccucuucccucgcuguuacccugaugcuggccauuuucaucguguauauggucagccgggacaaugugucuuguuccauuugccucuga

SEQ ID NO: 210999 - RNA, 1755 nt, Artificial Sequence; identical to SEQ ID NO: 209591
  derived and/or modified sequence opt5 from hemagglutinin__InfluenzaB__AHL92486

SEQ ID NO: 211000 - RNA, 1755 nt, Artificial Sequence; identical to SEQ ID NO: 209844
  derived and/or modified sequence opt5 from hemagglutinin__InfluenzaB__AHL92497

SEQ ID NO: 211001 - RNA, 1755 nt, Artificial Sequence; identical to SEQ ID NO: 209844
  derived and/or modified sequence opt5 from hemagglutinin__InfluenzaB__AHL92508

SEQ ID NO: 211002 - RNA, 1755 nt, Artificial Sequence; identical to SEQ ID NO: 209844
  derived and/or modified sequence opt5 from hemagglutinin__InfluenzaB__AHL92519

SEQ ID NO: 211003 - RNA, 1755 nt, Artificial Sequence; identical to SEQ ID NO: 209844
  derived and/or modified sequence opt5 from hemagglutinin__InfluenzaB__AHL92530

SEQ ID NO: 211004 - RNA, 1755 nt, Artificial Sequence; identical to SEQ ID NO: 209591
  derived and/or modified sequence opt5 from hemagglutinin__InfluenzaB__AHL92541

SEQ ID NO: 211005 - RNA, 1752 nt, Artificial Sequence
  derived and/or modified sequence opt5 from hemagglutinin__InfluenzaB__AHL92563
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaagaaauccuacuucgcgaaucuuaagggcacccggacgcgcgggaaacugugucccgauugccucaacuguaccgaccuggauguggcucuuggaagaccuaugugcgucggcacaacccccucugccaaggccagcauucugcaugaagugcggccuguuacauccggguguuuucccaucaugcacgaccgcaccaagaucagacaacucccuaaucugcugcggggauaugagaacauucgccucucuacgcagaaugugaucgaugcugaaaaagccccgggcggccccuacagacuggggacaagcggauccugcccuaacgcuaccagcaagauuggcuucuuugccacaauggcgugggccguccccaaagacaauuauaagaacgcuaccaauccucuuaccguggaggugcccuacaucuguacagaaggggaggaucagauuacggucuggggauuccauucugacaacaaaacccagaugaagaaucuguauggcgauuccaacccgcaaaaguuuacaagcucugccaaugggguuaccacacacuacgugucccagaucggagacuucccugaucagaccgaggacggcggccucccccagagcgggcggauuguggucgauuauaugaugcaaaaaccuggaaagacgggcacaaucguguaccagcgcgggguucugcuuccccagaaaguguggugcgcuucuggaagauccaaggucaucaaaggcagccugccccucauuggggaagccgacugucugcaugagaaguacggaggccugaacaaauccaagccuuauuacaccggcgaacacgcgaaggccaucgggaacugcccgauuugggugaaaacaccccucaagcuggcuaauggaaccaaauaucggccucccgccaagcugcugaaagagcgcggcuuuuucggggcuaucgccggauuucucgagggcgggugggaaggcaugauugccggauggcacggcuacaccucucauggggcucacggaguugcgguggccgcugaccuuaagagcacacaggaggccaucaacaagaucacgaaaaaucuuaacucccugagcgaacucgaggucaagaaucugcaaagacugucuggcgccauggaugaacuccauaacgagauucuggagcuugacgaaaaaguggaugaccugcgggcugauaccaucuccagccagauugagcucgccguccugcuuucuaaugaagggaucauuaacagcgaggacgaacaucugcucgcgcuggagcgcaagcugaaaaagaugcucggaccuuccgcuguggauaucggcaauggguguuucgagacaaagcacaaaugcaaccagaccugccuggacagaaucgccgccggcacauuuaaugcuggagaguucucucuucccaccuuugauagccugaacauuacggccgcuucccucaaugacggccuggauaaccacaccauccugcuuuauuacagcacagccgcgucuucccucgccguuacccugaugcuggcuauuuucaucguguauauggucagccgggacaaugugucuuguuccauuugccucuga

SEQ ID NO: 211006 - RNA, 1755 nt, Artificial Sequence; identical to SEQ ID NO: 209844
  derived and/or modified sequence opt5 from hemagglutinin__InfluenzaB__AHL92574

SEQ ID NO: 211007 - RNA, 1755 nt, Artificial Sequence
  derived and/or modified sequence opt5 from hemagglutinin__InfluenzaB__AHL92585
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcgccacccccucugccaaagcuagcauucugcaugaagugcggccuguuacauccggguguuuucccaucaugcacgaccgcaccaagaucagacaacucccuaaucugcugcggggauaugagaacauucgccucucuacgcagaaugugaucgaugccgaaaaggcuccgggcggccccuacagacuggggacaagcggauccugcccuaacgccaccagcaaaucuggcuucuuugcgacaauggccugggcuguccccaaggacaauaacaaaaaugccaccaacccucuuaccguggaggugcccuauauuuguacagaaggggaggaucagaucacggucuggggauuccauuccgacaauaagacccagaugaaaaaccuguacggcgauagcaauccgcaaaaguuuacaucuuccgcuaacgggguuaccacacacuaugugagccagauuggaucuuucccugaccagaccgaggauggcggccucccccaguccgggcggaucguggucgacuacaugaugcaaaagccuggaaaaacgggcacaauuguguaucagcgcgggguucugcuuccccagaagguguggugcgccagcggaagauccaaagucaucaagggcucucugccccucaucggggaagcggauugucugcaugagaaauacggaggccugaacaagagcaaaccuuacuauaccggcgaacacgccaaggcuauugggaauugcccgaucugggugaagacaccccucaaacuggccaacggaaccaaguaccggccucccgcuaaacuucugaaggagcgcggcuuuuucggggccauugccggauuucucgagggcgggugggaaggcaugaucgcuggauggcacggcuauaccucccauggggcgcacggaguugccguggcugccgaccugaaaagcacacaggaggccauuaauaagaucacgaagaaccuuaauucucuguccgaacucgaggucaaaaaccugcaaagacugagcggcgcuauggacgaacuccauaaugagauccuggagcuugaugaaaagguggacgaucugcgggccgacaccauuucuagccagaucgagcucgcgguccugcuuuccaacgaagggauuaucaauucugaggaugaacaucugcucgcucuggagcgcaaacugaagaaaaugcucggaccuagcgccguggagauuggcaacggguguuucgaaacaaagcacaagugcaaucagaccugccuggacagaaucgccgcuggcacauuuaacgccggagaguucucccuucccaccuuugauagccugaauaucacggcugccucucucaacgacgauggccuggacaaucacaccauucugcuuuacuauuccacagcggccagcucucucgcuguuacccugaugcuggccaucuucauuguguacauggucucccgggauaacgugagcuguuccaucugccucuga

SEQ ID NO: 211008 - RNA, 1755 nt, Artificial Sequence; identical to SEQ ID NO: 209844
  derived and/or modified sequence opt5 from hemagglutinin__InfluenzaB__AHL92596

SEQ ID NO: 211009 - RNA, 1755 nt, Artificial Sequence; identical to SEQ ID NO: 209591
  derived and/or modified sequence opt5 from hemagglutinin__InfluenzaB__AHL92607

SEQ ID NO: 211010 - RNA, 1755 nt, Artificial Sequence
  derived and/or modified sequence opt5 from hemagglutinin__InfluenzaB__AHL92629
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccggaaaaguccuacuucgcgaaucuuaaaggcacccggacgcgcgggaagcugugucccgauugccucaacuguaccgaccuggauguggcucuuggaagaccuaugugcgucggcacaacccccucugccaaagccagcauucugcaugaggugcggccuguuacauccggguguuuucccaucaugcacgaccgcaccaagaucagacaacucccuaaucugcugcggggauaugaaaacauucgccucucuacgcagaaugugaucgaugcugagaaggccccgggcggccccuacagacuggggacaagcggauccugcccuaacgcuaccagcaaaauuggcuucuuugccacaauggcgugggccguccccaaggacaauuauaaaaacgcuaccaauccucuuaccguggaagugcccuacaucuguacagagggggaggaucagauuacggucuggggauuccauucugacaacaagacccagaugaaaaaucuguauggcgauuccaacccgcaaaaguuuacaagcucugccaaugggguuaccacacacuacgugucccagaucggagacuucccugaucagaccgaagacggcggccucccccagagcgggcggauuguggucgauuauaugaugcaaaagccuggaaaaacgggcacaaucguguaccagcgcgggguucugcuuccccagaagguguggugcgcuucuggaagauccaaagucaucaagggcagccugccccucauuggggaggccgacugucugcaugaaaaauacggaggccugaacaaguccaaaccuuauuacaccggcgagcacgcgaaggccaucgggaacugcccgauuugggugaagacaccccucaaacuggcuaauggaaccaaguaucggccucccgccaaacuucugaaggagcgcggcuuuuucggggcuaucgccggauuucucgaaggcgggugggagggcaugauugccggauggcacggcuacaccucucauggggcucacggaguugcgguggccgcugaccugaaaagcacacaggaagccaucaacaagaucacgaagaaucuuaacucccugagcgagcucgaagucaaaaaucugcaaagacugucuggcgccauggaugagcuccauaacgagauucuggaacuugacgagaagguggaugaccugcgggcugauaccaucuccagccagauugaacucgccguccugcuuucuaaugaggggaucauuaacagcgaagacgagcaucugcucgcgcuggagcgcaaacugaagaaaaugcucggaccuuccgcuguggauaucggcaauggguguuucgaaacaaagcacaagugcaaccagaccugccuggacagaaucgccgccggcacauuuaaugcuggagaguucucucuucccaccuuugauagccugaacauuacggccgcuucccucaaugacgauggccuggacaaccacaccauccugcuuuauuacagcacagccgcgucuucccucgccguuacccugaugcuggcuauuuucaucguguauauggucagccgggacaaugugucuuguuccauuugccucuga

SEQ ID NO: 211011 - RNA, 1755 nt, Artificial Sequence; identical to SEQ ID NO: 209591
  derived and/or modified sequence opt5 from hemagglutinin__InfluenzaB__AHL92640

SEQ ID NO: 211012 - RNA, 1755 nt, Artificial Sequence; identical to SEQ ID NO: 209591
  derived and/or modified sequence opt5 from hemagglutinin__InfluenzaB__AHL92651

SEQ ID NO: 211013 - RNA, 1755 nt, Artificial Sequence
  derived and/or modified sequence opt5 from hemagglutinin__InfluenzaB__AHL92684
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauauuuguacggaaggggaggaucagaucaccgucuggggauuccauuccgacaauaagacacagaugaaaaaccuguacggcgauagcaauccgcaaaaguuuaccucuuccgccaacgggguuacaacccacuaugugagccagauuggaucuuucccugaccagacggaggauggcggccucccccaguccgggcggaucguggucgacuacaugaugcaaaagccuggaaaaacaggcaccauuguguaucagcgcgggguucugcuuccccagaagguguggugcgcuagcggaagauccaaagucaucaagggcucucugccccucaucggggaagccgauugucugcaugagaaauacggaggccugaacaagagcaaaccuuacuauaccggcgaacacgcgaaggccauugggaauugcccgaucugggugaagacaccccucaaacuggcuaacggaaccaaguaccggccucccgccaaacuucugaaggagcgcggcuuuuucggggcuauugccggauuucucgagggcgggugggaaggcaugaucgccggauggcacggcuauacaucccauggggcucacggaguugcgguggccgcugaccugaaaagcacgcaggaggccauuaauaagaucaccaagaaccuuaauucucuguccgaacucgaggucaaaaaccugcaaagacugagcggcgccauggacgaacuccauaaugagauccuggagcuugaugaaaagguggacgaucugcgggcugacacaauuucuagccagaucgagcucgccguccugcuuuccaacgaagggauuaucaauucugaggaugaacaucugcucgcgcuggagcgcaaacugaagaaaaugcucggaccuagcgcuguggagauuggcaacggguguuucgaaaccaagcacaagugcaaucagacaugccuggacagaaucgccgccggcaccuuuaacgcuggagaguucucccuucccacguuugauagccugaauaucaccgccgcuucucucaacgacgauggccuggacaaucacauuauccugcuuuacuauuccacagccgcgagcucucucgccguuacccugaugcuggcuauuuucaucguguacauggucucccgggauaacgugagcuguuccauuugccucuga

SEQ ID NO: 211014 - RNA, 1755 nt, Artificial Sequence; identical to SEQ ID NO: 209844
  derived and/or modified sequence opt5 from hemagglutinin__InfluenzaB__AHL92695

SEQ ID NO: 211015 - RNA, 1755 nt, Artificial Sequence; identical to SEQ ID NO: 209844
  derived and/or modified sequence opt5 from hemagglutinin__InfluenzaB__AHL92706

SEQ ID NO: 211016 - RNA, 1755 nt, Artificial Sequence
  derived and/or modified sequence opt5 from hemagglutinin__InfluenzaB__AHL92728
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcaagcacgcgaaggccaucgggaacugcccgauuugggugaaaacaccccucaagcuggcuaauggaaccaaauaucggccucccgccaagcugcugaaagaacgcggcuuuuucggggcuaucgccggauuucucgagggcgggugggagggcaugauugccggauggcacggcuacacaucucauggggcucacggaguugcgguggccgcugaccuuaagagcacgcaggaagccaucaacaagaucaccaaaaaucuuaacucccugagcgagcucgaagucaagaaucugcaaagacugucuggcgccauggaugagcuccauaacgaaauuaucgagcuggacgagaaaguggaugaccuucgggcugauacaauuuccagccagaucgaacuggccguccuccugucuaaugaggggauuaucaacagcgaagacgagcaccuucuggcgcucgaacgcaagcugaaaaagaugcugggaccuuccgcuguggauaucggcaauggguguuucgagaccaagcacaaaugcaaccagacaugccucgacagaauugccgccggcaccuuuaaugcuggagaguucucucugcccacguuugauagccuuaacaucaccgccgcuucccugaaugacgauggccucgacaaccauacaauucugcuguauuacagcaccgccgcgucuucccuugccguuacacucaugcuggcuaucuucauuguguauauggucagccgggacaaugugucuuguuccaucugccuguga

SEQ ID NO: 211017 - RNA, 1755 nt, Artificial Sequence; identical to SEQ ID NO: 211016
  derived and/or modified sequence opt5 from hemagglutinin__InfluenzaB__AHL92739

SEQ ID NO: 211018 - RNA, 1755 nt, Artificial Sequence; identical to SEQ ID NO: 211016
  derived and/or modified sequence opt5 from hemagglutinin__InfluenzaB__AHL92750

SEQ ID NO: 211019 - RNA, 1755 nt, Artificial Sequence; identical to SEQ ID NO: 209844
  derived and/or modified sequence opt5 from hemagglutinin__InfluenzaB__AHL92761

SEQ ID NO: 211020 - RNA, 1755 nt, Artificial Sequence
  derived and/or modified sequence opt5 from hemagglutinin__InfluenzaB__AHL92772
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcaugggcaccacacccucugccaaagccagcauucugcaugaaguccggccugugaccuccggguguuuucccaucaugcacgaccgcacgaagaucagacaacucccuaaucugcugcggggauaugagaacauucgccucucuacacagaauguuaucgaugcugaaaaggccccgggcggccccuacagacuggggaccagcggauccugcccuaacgcuacaagcaaaauuggcuucuuugccaccauggcgugggccgugcccaaggacaauuauaaaaacgcuaccaauccucuuacagucgaggugcccuacaucuguacggaaggggaggaucagauuaccguguggggauuccauucugacaacaagacacagaugaaaaaucuguauggcgauuccaacccgcaaaaguuuaccagcucugccaauggggucacaacccacuacguuucccagaucggagacuucccugaucagacggaggacggcggccucccccagagcgggcggauugugguggauuauaugaugcaaaagccuggaaaaacaggcaccaucgucuaccagcgcggggugcugcuuccccagaagguuuggugcgcuucuggaagauccaaagugaucaagggcagccugccccucauuggggaagccgacugucugcaugagaaauacggaggccugaacaaguccaaaccuuauuacaccggcgaacacgcgaaggccaucgggaacugcccgauuugggucaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguggcgguugccgcugaccugaaaagcacgcaggaggccaucaacaagaucaccaagaaucuuaacucccugagcgaacucgaggugaaaaaucugcaaagacugucuggcgccauggaugaacuccauaacgagauucuggagcuugacgaaaaggucgaugaccugcgggcugauacaaucuccagccagauugagcucgccgugcugcuuucuaaugaagggaucauuaacagcgaggacgaacaucugcucgcgcuggagcgcaaacugaagaaaaugcucggaccuuccgcugucgauaucggcaauggguguuucgagaccaagcacaagugcaaccagacaugccuggacagaaucgccgccggcaccuuuaaugcuggagaguucucucuucccacguuugauagccugaacauuaccgccgcuucccucaaugacgauggccuggacaaccacacaauccugcuuuauuacagcaccgccgcgucuucccucgccgugacacugaugcuggcuauuuucaucguuuauauggugagccgggacaaugucucuuguuccauuugccucuga

SEQ ID NO: 211021 - RNA, 1755 nt, Artificial Sequence; identical to SEQ ID NO: 209844
  derived and/or modified sequence opt5 from hemagglutinin__InfluenzaB__AHL92794

SEQ ID NO: 211022 - RNA, 1755 nt, Artificial Sequence; identical to SEQ ID NO: 209844
  derived and/or modified sequence opt5 from hemagglutinin__InfluenzaB__AHL92805

SEQ ID NO: 211023 - RNA, 1755 nt, Artificial Sequence; identical to SEQ ID NO: 209844
  derived and/or modified sequence opt5 from hemagglutinin__InfluenzaB__AHL92816

SEQ ID NO: 211024 - RNA, 1755 nt, Artificial Sequence
  derived and/or modified sequence opt5 from hemagglutinin__InfluenzaB__AHL92827
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaaagacugucuggcgccauggaugaacuccauaacgagauucuggagcuugacgaaaagguggaugaccugcgggcugauacaaucuccagccagauugagcucgccguccugcuuucuaaugaagggaucauuaacagcgaggacgaacaucugcucgcgcuggagcgcaaacugaagaaaaugcucggaccuuccgcuguggauaucggcaauggguguuucgagaccaagcacaagugcaaccagacaugccuggacagaaucgccgccggcaccuuuaaugcuggagaguucucucuucccacguuugauagccugaacauuaccgccgcuucccucaaugacgauggccuggacaaccacacaauccugcuuuauuacagcaccgccgcgucuucccucgccguuacacugaugcuggcuauuuucguggucuauauggugagccgggacaauguuucuuguuccaucugccucuga

SEQ ID NO: 211025 - RNA, 1755 nt, Artificial Sequence; identical to SEQ ID NO: 209844
  derived and/or modified sequence opt5 from hemagglutinin__InfluenzaB__AHL92838

SEQ ID NO: 211026 - RNA, 1755 nt, Artificial Sequence; identical to SEQ ID NO: 209844
  derived and/or modified sequence opt5 from hemagglutinin__InfluenzaB__AHL92849

SEQ ID NO: 211027 - RNA, 1755 nt, Artificial Sequence; identical to SEQ ID NO: 209844
  derived and/or modified sequence opt5 from hemagglutinin__InfluenzaB__AHL92860

SEQ ID NO: 211028 - RNA, 1758 nt, Artificial Sequence; identical to SEQ ID NO: 209662
  derived and/or modified sequence opt5 from hemagglutinin__InfluenzaB__AHL92871

SEQ ID NO: 211029 - RNA, 1755 nt, Artificial Sequence; identical to SEQ ID NO: 209450
  derived and/or modified sequence opt5 from hemagglutinin__InfluenzaB__AHL92882

SEQ ID NO: 211030 - RNA, 1758 nt, Artificial Sequence
  derived and/or modified sequence opt5 from hemagglutinin__InfluenzaB__AHL92893
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaaggaaacacagauggccaaacuuuauggggauuccaaaccccagaaguuuaccagcucugcuaacggagucacaacccacuacguuucccaaaucggcggcuucccgaaccagacggaggacgggggacugccucagagcggccgcauugugguggauuauaugguccagaaaucugggaagacaggaaccaucaccuaccaaagaggcauucuccugccccagaaaguguggugcgccuccgggcggagcaagguuaucaaaggaucccuuccucugauuggcgaagcugacugucuccaugagaaguauggcgggcugaauaagucuaaacccuacuacacaggagagcacgccaaggcgaucggcaacugccccaucugggugaaaaccccucugaagcucgccaaugggacaaaauaucgcccgcccgcuaagcugcuuaaggaaagaggauuuuucggcgccauugcuggguuucuggagggcggaugggaaggcaugaucgccggguggcauggauacacgagccacggcgcccacggggucgcuguggcggccgaucucaaauccacccaggaggcuauuaacaagaucacaaagaaucugaacagccuuucugaacuggagguuaagaaucuccagcggcuguccggagccauggacgagcugcauaacgaaauucucgagcuggaugaaaaaguggacgaccuucgcgccgauaccaucagcucucaaaucgagcuggcuguccuccugagcaaugaaggcauuaucaacuccgaggacgagcaccuucuggcccucgaaagaaagcugaagaaaaugcuggggccuucugcgguggagauuggcaauggauguuucgaaacaaagcauaaaugcaaccagaccugccucgaucggaucgcugccggcacguuugacgccggggaguucagccugcccaccuuugauucccuuaauauuacagcugccagccugaacgacgauggacucgacaaucacaccauccugcuguauuacucuacagcugccuccagccuugcggucacccucaugauugccaucuucaucguguauaugguuucucgcgauaacguguccuguagcauuugccuguga

SEQ ID NO: 211031 - RNA, 1755 nt, Artificial Sequence; identical to SEQ ID NO: 210047
  derived and/or modified sequence opt5 from hemagglutinin__InfluenzaB__AHL92904

SEQ ID NO: 211032 - RNA, 1758 nt, Artificial Sequence
  derived and/or modified sequence opt5 from hemagglutinin__InfluenzaB__AHL92915
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaauauucccucugccgaagucagcauccugcacgaggugagaccuguuacauccggguguuuucccaucaugcaugaucggaccaaaauucgccaacucccuaaccugcugagaggauacgaacacauccggcucucuacgcauaaugugauuaacgccgagaaggcuccgggcggccccuauaaaaucgggacaagcggauccugcccuaaugucaccaacggcaauggguucuuugccacaauggcuugggccgugcccaagaacgacaauaacaaaaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggccgcauugugguggauuauaugguccagaagucugggaaaacaggaaccaucaccuaccaaagaggcauucuccugccccagaagguguggugcgccuccgggcggagcaaaguuaucaagggaucccuuccucugauuggcgaagcugacugucuccaugagaaauauggcgggcugaacaagucuaagcccuacuacacaggagagcacgccaaagcgaucggcaauugccccaucugggugaagaccccucugaaacucgccaacgggacaaaguaucgcccgcccgcuaaacugcuuaaggaaagaggauuuuucggcgccauugcuggguuucuggagggcggaugggaaggcaugaucgccggguggcauggauacacgagccacggcgcccacggggucgcuguggcggccgaucucaaguccacccaggaggcuauuaauaaaaucacaaagaaccugaauagccuuucugaacuggagguuaaaaaccuccagcggcuguccggagccauggacgagcugcauaaugaaauucucgagcuggaugaaaagguggacgaccuucgcgccgauaccaucagcucucaaaucgagcuggcuguccuccugagcaacgaaggcauuaucaauuccgaggacgagcaccuucuggcccucgaaagaaaacugaagaagaugcuggggccuucugcgguggagauuggcaacggauguuucgaaacaaaacauaagugcaaucagaccugccucgaucggaucgcugccggcacguuugacgccggggaguucagccugcccaccuuugauucccuuaacauuacagcugccagccugaaugacgauggacucgacaaccacaccauccugcuguauuacucuacagcugccuccagccuugcggucacccucaugauugccaucuucaucguguauaugguuucucgcgauaacguguccuguagcauuugccuguga

SEQ ID NO: 211033 - RNA, 1758 nt, Artificial Sequence; identical to SEQ ID NO: 209662
  derived and/or modified sequence opt5 from hemagglutinin__InfluenzaB__AHL92926

SEQ ID NO: 211034 - RNA, 1755 nt, Artificial Sequence; identical to SEQ ID NO: 210623
  derived and/or modified sequence opt5 from hemagglutinin__InfluenzaB__AHL92937

SEQ ID NO: 211035 - RNA, 1758 nt, Artificial Sequence; identical to SEQ ID NO: 209538
  derived and/or modified sequence opt5 from hemagglutinin__InfluenzaB__AHL92948

SEQ ID NO: 211036 - RNA, 1758 nt, Artificial Sequence; identical to SEQ ID NO: 209538
  derived and/or modified sequence opt5 from hemagglutinin__InfluenzaB__AHL92959

SEQ ID NO: 211037 - RNA, 1758 nt, Artificial Sequence; identical to SEQ ID NO: 209538
  derived and/or modified sequence opt5 from hemagglutinin__InfluenzaB__AHL92970

SEQ ID NO: 211038 - RNA, 1758 nt, Artificial Sequence; identical to SEQ ID NO: 209538
  derived and/or modified sequence opt5 from hemagglutinin__InfluenzaB__AHL92981

SEQ ID NO: 211039 - RNA, 1758 nt, Artificial Sequence; identical to SEQ ID NO: 209538
  derived and/or modified sequence opt5 from hemagglutinin__InfluenzaB__AHL92992

SEQ ID NO: 211040 - RNA, 1758 nt, Artificial Sequence; identical to SEQ ID NO: 210963
  derived and/or modified sequence opt5 from hemagglutinin__InfluenzaB__AHL93004

SEQ ID NO: 211041 - RNA, 1758 nt, Artificial Sequence; identical to SEQ ID NO: 209538
  derived and/or modified sequence opt5 from hemagglutinin__InfluenzaB__AHL93015

SEQ ID NO: 211042 - RNA, 1758 nt, Artificial Sequence; identical to SEQ ID NO: 209538
  derived and/or modified sequence opt5 from hemagglutinin__InfluenzaB__AHL93026

SEQ ID NO: 211043 - RNA, 1755 nt, Artificial Sequence; identical to SEQ ID NO: 210987
  derived and/or modified sequence opt5 from hemagglutinin__InfluenzaB__AHL93037

SEQ ID NO: 211044 - RNA, 1755 nt, Artificial Sequence; identical to SEQ ID NO: 210987
  derived and/or modified sequence opt5 from hemagglutinin__InfluenzaB__AHL93048

SEQ ID NO: 211045 - RNA, 1755 nt, Artificial Sequence; identical to SEQ ID NO: 211016
  derived and/or modified sequence opt5 from hemagglutinin__InfluenzaB__AHL93059

SEQ ID NO: 211046 - RNA, 1755 nt, Artificial Sequence; identical to SEQ ID NO: 209844
  derived and/or modified sequence opt5 from hemagglutinin__InfluenzaB__AHL93070

SEQ ID NO: 211047 - RNA, 1755 nt, Artificial Sequence
  derived and/or modified sequence opt5 from hemagglutinin__InfluenzaB__AHL93081
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaaagacugucuggcgccauggaugaacuccauaacgagauucuggagcuugacgggaagguggaugaccugcgggcugauacaaucuccagccagauugaacucgccguccugcuuucuaaugagggaaucauuaacagcgaagacgagcaucugcucgcgcuggaacgcaaacugaagaaaaugcucggcccuuccgcuguggauaucgggaauggcuguuucgagaccaagcacaagugcaaccagacaugccuggacagaaucgccgccggaaccuuuaaugcuggcgaguucucucuucccacguuugauagccugaacauuaccgccgcuucccucaaugacgaugggcuggacaaccacacaauccugcuuuauuacagcaccgccgcgucuucccucgccguuacacugaugcuggcuauuuucaucguguauauggucagccgggacaaugugucuuguuccauuugccucuga

SEQ ID NO: 211048 - RNA, 1755 nt, Artificial Sequence; identical to SEQ ID NO: 209844
  derived and/or modified sequence opt5 from hemagglutinin__InfluenzaB__AHL93092

SEQ ID NO: 211049 - RNA, 1755 nt, Artificial Sequence; identical to SEQ ID NO: 209844
  derived and/or modified sequence opt5 from hemagglutinin__InfluenzaB__AHL93103

SEQ ID NO: 211050 - RNA, 1755 nt, Artificial Sequence; identical to SEQ ID NO: 209844
  derived and/or modified sequence opt5 from hemagglutinin__InfluenzaB__AHL93114

SEQ ID NO: 211051 - RNA, 1755 nt, Artificial Sequence; identical to SEQ ID NO: 209591
  derived and/or modified sequence opt5 from hemagglutinin__InfluenzaB__AHL93125

SEQ ID NO: 211052 - RNA, 1755 nt, Artificial Sequence
  derived and/or modified sequence opt5 from hemagglutinin__InfluenzaB__AHL93136
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagagaguguggugcgcuucuggacgguccaaggucaucaaaggcagccugccccucauuggggaagccgacugucugcaugagaaguacggaggccugaacaaauccaagccuuauuacaccggcgaacacgcgaaagccaucgggaacugcccgauuugggugaagacaccccucaagcuggcuaauggaaccaaauaucgcccucccgccaagcugcugaaagagagaggcuuuuucggggcuaucgccggauuucucgagggcgggugggaaggcaugauugccggauggcacggcuacacaucucauggggcucacggaguugcgguggccgcugaccuuaagagcacgcaggaggccaucaacaaaaucaccaagaaucuuaacucccugagcgaacucgaggucaagaaucugcaacggcugucuggcgccauggaugaacuccauaacgagauucuggagcuugacgaaaaaguggaugaccugcgcgcugauacaaucuccagccagauugagcucgccguccugcuuucuaaugaagggaucauuaacagcgaggacgaacaucugcucgcgcuggagagaaagcugaaaaagaugcucggaccuuccgcuguggauaucggcaauggguguuucgagaccaaacacaagugcaaccagacaugccuggaccggaucgccgccggcaccuuuaaugcuggagaguucucucuucccacguuugauagccugaacauuaccgccgcuucccucaaugacgauggccuggacaaccacacaauccugcuuuauuacagcaccgccgcgucuucccucgccguuacacugaugcuggcuauuuucaucguguauauggucagcagagacaaugugucuuguuccauuugccucuga

SEQ ID NO: 211053 - RNA, 1755 nt, Artificial Sequence; identical to SEQ ID NO: 209591
  derived and/or modified sequence opt5 from hemagglutinin__InfluenzaB__AHL93147

SEQ ID NO: 211054 - RNA, 1755 nt, Artificial Sequence; identical to SEQ ID NO: 209844
  derived and/or modified sequence opt5 from hemagglutinin__InfluenzaB__AHL93158

SEQ ID NO: 211055 - RNA, 1755 nt, Artificial Sequence
  derived and/or modified sequence opt5 from hemagglutinin__InfluenzaB__AHL93169
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugcuuuaacuguacagaccucgauguggcucugggaagaccuaugugcgucggcaccacacccucugccaaagccagcauucuucaugaagugcggccuguuaccuccggguguuuccccaucaugcacgaccgcacgaagaucagacaacugccuaaucuccugcggggauaugagaacauucgccugucuacacagaaugugaucgaugcugaaaaggccccgggcggccccuacagacucgggaccagcggauccugcccuaacgcuacaagcaaaauuggcuuuuucgccaccauggcgugggccguccccaaggacaauuauaaaaacgcuaccaauccucugacaguggaggugcccuacaucuguacggaaggggaggaucagauuaccgucuggggauuucauucugacaacaagacacagaugaaaaaucuuuauggcgauuccaacccgcaaaaguucaccagcucugccaaugggguuacaacccacuacgugucccagaucggagacuuuccugaucagacggaggacggcggccugccccagagcgggcggauuguggucgauuauaugaugcaaaagccuggaaaaacaggcaccaucguguaccagcgcgggguucuccugccccagaagguguggugcgcuucuggaagauccaaagucaucaagggcagccuuccccugauuggggaagccgacugucuccaugagaaauacggaggccugaacaaguccaaaccuuauuacaccggcgaacacgcgaaggccaucgggaacugcccgauuugggugaagacaccccugaaacucgcuaauggaaccaaguaucggccucccgccaaacugcuuaaggagcgcggcuucuuuggggcuaucgccggauuccuggagggcgggugggaaggcaugauugccggauggcacggcuacacaucucauggggcucacggaguugcgguggccgcugaccucaaaagcacgcaggaggccaucaacaagaucaccaagaaucugaacucccuuagcgaacuggaggucaaaaaucuccaaagacugucuggcgccauggaugaacugcauaacgagauucucgagcuggacgaaaagguggaugaccuucgggcugauacaaucuccagccagauugagcuggccguccuccugucuaaugaagggaucauuaacagcgaggacgaacaccuucuggcgcucgagcgcaaacugaagaaaaugcugggaccuuccgcuguggauaucggcaauggguguuuugagaccaagcacaagugcaaccagacaugccucgacagaaucgccgccggcaccuucaaugcuggagaauuuucucugcccacguucgauagccuuaacauuaccgccgcuucccugaaugacgauggccucgacaaccauacaauccugcuguauuacagcaccgccgcgucuucccuugccguuacacucaugcuggcuauuuucaucguguauauggucagccgggacaaugugucuuguuccauuugccuguga

SEQ ID NO: 211056 - RNA, 1755 nt, Artificial Sequence
  derived and/or modified sequence opt5 from hemagglutinin__InfluenzaB__AHL93180
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucauccacgaccgcacgaagauuagacaacucccuaaucugcugcggggauaugagaacauccgccucucuacacagaaugugauugaugcugaaaaggccccgggcggccccuacagacuggggaccagcggauccugcccuaacgcuacaagcaaaucuggcuucuuugccaccauggcgugggccguccccaaggacaauaacaaaaaugcuaccaacccucuuacaguggaggugcccuauaucuguacggaaggggaggaucagauuaccgucuggggauuccauuccgacaauaagacacagaugaaaaaccuguacggcgauagcaauccgcaaaaguuuaccucuuccgccaacgggguuacaacccacuaugugagccagaucggaucuuucccugaccagacggaggauggcggccucccccaguccgggcggauuguggucgacuacaugaugcaaaagccuggaaaaacaggcaccaucguguaucagcgcgggguucugcuuccccagagaguguggugcgcuagcggacgguccaaggucaucaaaggcucucugccccucauuggggaagccgauugucugcaugagaaguacggaggccugaacaaaagcaagccuuacuauaccggcgaacacgcgaaagccaucgggaauugcccgauuugggugaagacaccccucaagcuggcuaacggaaccaaauaccgcccucccgccaagcugcugaaagagagaggcuuuuucggggcuaucgccggauuucucgagggcgggugggaaggcaugauugccggauggcacggcuauacaucccauggggcucacggaguugcgguggccgcugaccuuaagagcacgcaggaggccaucaauaaaaucaccaagaaccuuaauucucuguccgaacucgaggucaagaaccugcaacggcugagcggcgccauggacgaacuccauaaugagauucuggagcuugaugaaaaaguggacgaucugcgcgcugacacaaucucuagccagauugagcucgccguccugcuuuccaacgaagggaucauuaauucugaggaugaacaucugcucgcgcuggagagaaagcugaaaaagaugcucggaccuagcgcuguggagaucggcaacggguguuucgaaaccaaacacaagugcaaucagacaugccuggaccggaucgccgccggcaccuuuaacgcuggagaguucucccuucccacguuugauagccugaauauuaccgccgcuucucucaacgacgauggccuggacaaucacacaauccugcuuuacuauuccaccgccgcgagcucucucgccguuacacugaugcuggcuauuuucaucguguacauggucuccagagauaacgugagcuguuccauuugccucuga

SEQ ID NO: 211057 - RNA, 1755 nt, Artificial Sequence
  derived and/or modified sequence opt5 from hemagglutinin__InfluenzaB__AHL93191
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgacacaagcaaaauuggcuucuuugcuaccauggccugggcgguccccaaggauaauuauaaaaacgccaccaauccucuuacaguggaggugcccuacaucuguacggaaggggaggaccagauuaccgucuggggauuccauucugauaacaagacacagaugaaaaaucuguauggcgacuccaacccgcaaaaguuuaccagcucugcuaaugggguuacaacccacuacgugucccagaucggagauuucccugaccagacggaggauggcggccucccccagagcgggcggauuguggucgacuauaugaugcaaaagccuggaaaaacaggcaccaucguguaccagcgcgggguucugcuuccccagaagguguggugcgccucuggaagauccaaagucaucaagggcagccugccccucauuggggaagcugacugucugcaugagaaauacggaggccugaacaaguccaaaccuuauuacaccggcgaacacgccaaggcgaucgggaacugcccgauuugggugaagacaccccucaaacuggccaauggaaccaaguaucggccucccgcuaaacuucugaaggagcgcggcuuuuucggggccaucgcuggauuucucgagggcgggugggaaggcaugauugccggauggcacggcuacacaucucauggggcccacggaguugcuguggcggccgaucugaaaagcacgcaggaggcuaucaacaagaucaccaagaaucuuaacucccugagcgaacucgaggucaaaaaucugcaaagacugucuggcgccauggacgaacuccauaacgagauucuggagcuugaugaaaagguggacgaucugcgggccgacacaaucuccagccagauugagcucgcuguccugcuuucuaaugaagggaucauuaacagcgaggaugaacaucugcucgcccuggagcgcaaacugaagaaaaugcucggaccuuccgcgguggacaucggcaauggguguuucgagaccaagcacaagugcaaccagacaugccuggauagaaucgcugccggcaccuuuaaugccggagaguucucucuucccacguuugacagccugaacauuaccgcugccucccucaaugaugacggccuggacaaccacacaauccugcuuuauuacagcaccgcugccucuucccucgcgguuacacugaugcuggccauuuucaucguguauauggucagccgggauaaugugucuuguuccauuugccucuga

SEQ ID NO: 211058 - RNA, 1755 nt, Artificial Sequence
  derived and/or modified sequence opt5 from hemagglutinin__InfluenzaB__AHL93202
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauaugaugcaaaagccuggaaaaacaggcaccaucguguaccagcgcgggguucugcuuccccagaagguguggugcgcuucuggaagauccaaagucaucaagggcagccugccccucauuggggaagccgacugucugcaugagaaauacggaggccugaacaaguccaaaccuuauuacaccggcgaacacgcgaaggccaucgggaacugcccgauuugggugaagacaccccucaaacuggcuaauggaaccaaguaucggccucccgccaaacuucugaaggagcgcggcuuuuucggggcuaucgccggauuucucgagggcgggugggaaggcaugauugccggauggcacggcuacacaucucauggggcucacggaguugcgguggccgcugaccugaaaagcacgcaggaggccaucaacaagaucaccaagaaucuuaacucccugagcgaacucgaggucaaaaaucugcaaagacugucuggcgccauggaugaguuccauaacgaaauucucgagcuggacgaaaagguggaugaccuucgggcugauacaaucuccagccagauugagcuggccguccuccugucuaaugaagggaucauuaacagcgaggacgaacaccuucuggcgcucgagcgcaaacugaagaaaaugcugggaccuuccgcuguggauaucggcaauggguguuuugagaccaagcacaagugcaaccagacaugccucgacagaaucgccgccggcaccuucaaugcuggagaauuuucucugcccacguucgauagccuuaacauuaccgccgcuucccugaaugacgauggccucgacaaccauacaauccugcuguauuacagcaccgccgcgucuucccuugccguuacacucaugcuggcuauuuucaucguguauauggucagccgggacaaugugucuuguuccauuugccuguga

SEQ ID NO: 211059 - RNA, 1758 nt, Artificial Sequence; identical to SEQ ID NO: 210013
  derived and/or modified sequence opt5 from hemagglutinin__InfluenzaB__AHL93213

SEQ ID NO: 211060 - RNA, 1758 nt, Artificial Sequence; identical to SEQ ID NO: 210013
  derived and/or modified sequence opt5 from hemagglutinin__InfluenzaB__AHL93224

SEQ ID NO: 211061 - RNA, 1758 nt, Artificial Sequence
  derived and/or modified sequence opt5 from hemagglutinin__InfluenzaB__AHL93235
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgucucacggcgcccacgggguggcuguugcggccgaucucaagagcacccaggaggcuaucaacaaaauuacaaagaaucugaacucccugagcgaacuugaggugaaaaaucugcagcgccucucuggagccauggacgagcugcauaacgaaauccuggagcucgaugaaaaggucgacgaccugagagccgauaccauuuccagccaaaucgagcuugcugugcugcucucuaaugaaggcaucauuaacagcgaggacgagcaucugcuugcccuggaacggaaacucaagaagaugcuggggccuuccgcggucgagaucggcaauggauguuucgaaacaaaacacaagugcaaccagaccugccuggaucgcauugcugccggcacguuugacgccggggaguucucucuccccaccuuugauagccugaauaucacagcugccucccuuaacaaugacggacuggauaaccacaccauucuccuguauuacagcacagcugccucuucccuggcggugacccuuaugaucgccauuuucguuguguauauggucagcagagacaacgugucuuguuccaucugccucuga

SEQ ID NO: 211062 - RNA, 1758 nt, Artificial Sequence
  derived and/or modified sequence opt5 from hemagglutinin__InfluenzaB__AHL93246
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaaaaacaagaccgcgaccaauagccugacaauugaagugccuuacaucuguacggagggagaggaucagauuaccaucuggggcuuccacucugacaacgaaacacagauggccaaacuuuauggggauuccaagccccagaaguuuaccagcucugcuaacggagucacaacccacuacguuucccaaaucggcggcuucccgaaucagacggaggacgggggacugccucagagcggcagaauugugguggauuauaugguccagaaaucugggaagacaggaaccaucaccuaccaacggggcauucuccugccccagaaaguguggugcgccuccgggcgcagcaagguuaucaaaggaucccuuccucugauuggcgaagcugacugucuccaugagaaguauggcgggcugaacaaaucuaagcccuacuacacaggagagcacgccaaggcgaucggcaauugccccaucugggugaaaaccccucugaagcucgccaacgggacaaaauauagaccgcccgcuaagcugcuuaaagaacggggauuuuucggcgccauugcuggguuucuggagggcggaugggaaggcaugaucgccggguggcauggauacacgagccacggcgcccacggggucgcuguggcggccgaucucaaguccacccaggaggcuauuaauaagaucaccaaaaaccugaauagccuuggagaacuggagguuaagaaccuccagcgccugucuggcgccauggacgagcugcauaaugaaauucucgagcuggaugaaaaaguggacgaccuuagagccgauacaaucuccagccaaaucgagcuggcuguccuccugucuaacgaagggauuaucaauagcgaggacgagcaccuucuggcccucgaacggaagcugaaaaagaugcugggcccuuccgcgguggagauuggaaacggcuguuucgaaacaaagcauaaaugcaaucagaccugccucgaucgcaucgcugccgggacguuugacgccggagaguucucucugcccaccuuugauagccuuaacauuacagcugccucccugaaugacgauggccucgacaaccacaccauccugcuguauuacagcacagcugccucuucccuugcggucacccucaugauugccaucuucgugguuuauauggugagcagagauaacgucucuuguuccaucugccuguga

SEQ ID NO: 211063 - RNA, 1758 nt, Artificial Sequence; identical to SEQ ID NO: 210013
  derived and/or modified sequence opt5 from hemagglutinin__InfluenzaB__AHL93257

SEQ ID NO: 211064 - RNA, 1758 nt, Artificial Sequence; identical to SEQ ID NO: 210346
  derived and/or modified sequence opt5 from hemagglutinin__InfluenzaB__AHL93268

SEQ ID NO: 211065 - RNA, 1758 nt, Artificial Sequence
  derived and/or modified sequence opt5 from hemagglutinin__InfluenzaB__AHL93279
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaauuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggaaauccaagguuaucaaaggaagccuuccccugauuggcgaagcugacugucuccaugagaaguauggcgggcugaauaaguccaaacccuacuacacaggagagcacgccaaggcgaucggcaacugcccuaucugggugaaaaccccgcugaagcucgccaaugggacaaaauauagacccccugcuaagcugcuuaaggaacgcggauuuuucggcgccauugcuggguuucuggagggcggaugggaaggcaugaucgccggguggcauggauacacgucucacggcgcccacggggucgcuguggcggccgaucucaaaagcacccaggaggcuauuaacaagaucacaaagaaucugaacucccuuagcgaacuggagguuaagaaucuccagcggcugucuggagccauggacgagcugcauaacgaaauucucgagcuggaugaaaaaguggacgaccuucgcgccgauaccaucuccagccaaaucgagcuggcuguccuccugucuaaugaaggcauuaucaacagcgaggacgagcaccuucuggcccucgaaagaaagcugaagaaaaugcuggggcccuccgcgguggagauuggcaauggauguuucgaaacaaagcauaaaugcaaccagaccugccucgaucggaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugauugccaucuucgugguuuauauggugagccgcgauaacgucucuuguuccaucugccuguga

SEQ ID NO: 211066 - RNA, 1758 nt, Artificial Sequence; identical to SEQ ID NO: 210013
  derived and/or modified sequence opt5 from hemagglutinin__InfluenzaB__AHL93290

SEQ ID NO: 211067 - RNA, 1758 nt, Artificial Sequence
  derived and/or modified sequence opt5 from hemagglutinin__InfluenzaB__AHL93301
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuuaaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaacgucucuuguuccaucugccuguga

SEQ ID NO: 211068 - RNA, 1758 nt, Artificial Sequence
  derived and/or modified sequence opt5 from hemagglutinin__InfluenzaB__AHL93312
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuacgccacaauggcuugggccguccccaaaaacgacaagaauaaaaccgcgaccaacccucugacaaucgaagugcccuauauuuguacggagggagaggaucagaucaccguguggggcuuucacagcgacaaugaaacacagauggccaaacuuuacggggauucuaagccgcagaaguucaccuccagcgcuaacggagucacaacccacuauguuucucaaaucggcggcuuuccuaaccagacggaggacgggggacugccccaguccggcagaauugugguggauuacaugguccaaaagagcgggaaaacaggaaccaucaccuaucagcggggcauucuccugccucagaagguguggugcgccucugggcgcuccaaaguuaucaagggaagccuuccccugauuggcgaagcugacugucuccaugagaaauacggcgggcugaauaaguccaagcccuacuauacaggagagcacgccaaagcgaucggcaacugcccuaucugggugaagaccccgcugaaacucgccaaugggacaaaguacagacccccugcuaaacugcuuaaggaacggggauucuuuggcgccauugcuggguuccuggagggcggaugggaaggcaugaucgccggguggcauggauauacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuuugaaacaaaacauaagugcaaccagaccugccucgaucgcaucgcugccggcacguucgacgccggggaguuuucucugccuaccuucgauagccuuaauauuacagcugccucccugaacgacgauggacucgacaaucacaccauccugcuguacuauagcacagcugccucuucccuugcggucacccucaugauugccaucuuugugguuuacauggugagcagagauaacgucucuuguuccaucugccuguga

SEQ ID NO: 211069 - RNA, 1758 nt, Artificial Sequence
  derived and/or modified sequence opt5 from hemagglutinin__InfluenzaB__AHL93323
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcacaucugggcgcuccaaaguuaucaagggaagccuuccccugauuggcgaagccgacugucuccaugagaaauauggcgggcugaauaaguccaagcccuacuacaccggagagcacgcuaaagccaucggcaacugcccuaucugggugaagacaccgcugaaacucgcgaaugggacgaaguauagacccccugccaaacugcuuaaggaacggggauuuuucggcgcuauugccggguuucuggagggcggaugggaaggcaugaucgcuggguggcauggauacaccucucacggcgcccacggggucgccguggcugcggaucucaagagcacacaggaggccauuaacaaaaucaccaagaaucugaacucccuuagcgaacuggagguuaaaaaucuccagcgccugucuggagcuauggacgagcugcauaacgaaauucucgagcuggaugaaaagguggacgaccuuagagccgauacaaucuccagccaaaucgagcuggccguccuccugucuaaugaaggcauuaucaacagcgaggacgagcaccuucuggcucucgaacggaaacugaagaagaugcuggggcccuccgccguggagauuggcaauggauguuucgaaaccaaacauaagugcaaccagacgugccucgaucgcaucgcggcuggcaccuuugacgccggggaguucucucugccuacauuugauagccuuaauauuaccgccgcuucccugaacgacgauggacucgacaaucacacaauccugcuguauuacagcaccgccgcuucuucccuugccgucacgcucaugauugcgaucuucgugguuuauauggugagcagagauaacgucucuuguuccaucugccuguga

SEQ ID NO: 211070 - RNA, 1758 nt, Artificial Sequence
  derived and/or modified sequence opt5 from hemagglutinin__InfluenzaB__AHL93334
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaauauuaccaacggcaauggguucuuugccacaauggcuugggccgucccuaaaaacgacaagaauaaaaccgcgaccaacccccucacaaucgaagugccguacauuuguacggagggagaggaucagaucaccguguggggcuuccacagcgacaaugaaacacagauggccaagcuguauggggauucuaagccucagaaauuuaccuccagcgcuaacggagucacaacccacuacguuucucaaaucggcggcuuccccaaccagacggaggacgggggacuuccucaguccggcagaauugugguggauuauaugguccaaaagagcgggaaaacaggaaccaucaccuaccagcggggcauucugcucccccagaagguguggugcacaucugggcgcuccaaaguuaucaagggaagccugccccuuauuggcgaagccgacugucugcaugagaaauauggcgggcucaauaaguccaagccuuacuacaccggagagcacgcuaaagccaucggcaacugcccgaucugggugaagacaccccugaaacuggcgaaugggacgaaguauagaccucccgccaaacuccugaaggaacggggauuuuucggcgcuauugccggguuucuugagggcggaugggaaggcaugaucgcuggguggcauggauacaccucucacggcgcccacggggucgccguggcugcggaucucaagagcacacaggaggccauuaacaaaaucaccaagaaucugaacucccugagcgaacuugagguuaaaaaucugcagcgccucucuggagcuauggacgagcugcauaacgaaauucuggagcucgaugaaaagguggacgaccugagagccgauacaaucuccagccaaaucgagcuugccguccugcucucuaaugaaggcauuaucaacagcgaggacgagcaucugcuugcucuggaacggaaacucaagaagaugcuggggccuuccgccguggagauuggcaauggauguuucgaaaccaaacacaagugcaaccagacgugccuggaucgcaucgcggcuggcaccuuugacgccggggaguucucucuccccacauuugauagccugaauauuaccgccgcuucccuuaacgacgauggacuggacaaucacacaauccuccuguauuacagcaccgccgcuucuucccuggccgucacgcuuaugauugcgaucuucgugguuuauauggugagcagagauaacgucucuuguuccaucugccucuga

SEQ ID NO: 211071 - RNA, 1758 nt, Artificial Sequence; identical to SEQ ID NO: 210013
  derived and/or modified sequence opt5 from hemagglutinin__InfluenzaB__AHL93345

SEQ ID NO: 211072 - RNA, 1758 nt, Artificial Sequence; identical to SEQ ID NO: 210013
  derived and/or modified sequence opt5 from hemagglutinin__InfluenzaB__AHL93356

SEQ ID NO: 211073 - RNA, 1758 nt, Artificial Sequence
  derived and/or modified sequence opt5 from hemagglutinin__InfluenzaB__AHL93367
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaauauauccgccucucuacgcacaacgugauuaaugccgagaacgcuccgggcggccccuacaagaucgggacaagcggauccugcccuaauauuaccaacggcaauggguucuuugccacaauggcuugggccguccccaaaaacgacaagaauaaaaccgcgaccaacccucugacaaucgaagugcccuauauuuguacggagggagaggaucagaucaccguguggggcuuccauagcgacaaugaaacacagauggccaaacuuuacggggauucuaagccgcagaaguuuaccuccagcgcuaacggagucacaacccacuauguuucucaaaucggcggcuucccuaaccagacggaggacgggggacugccccaguccggcagaauugugguggauuacaugguccaaaagagcgggaaaacaggaaccaucaccuaucagcggggcauucuccugccucagaagguguggugcgccucugggcgcuccaaaguuaucaagggaagccuuccccugauuggcgaagcugacugucuccacgagaaauacggcgggcugaauaaguccaagcccuacuauacaggagagcaugccaaagcgaucggcaacugcccuaucugggugaagaccccgcugaaacucgccaaugggacaaaguacagacccccugcuaaacugcuuaaggaacggggauuuuucggcgccauugcuggguuucuggagggcggaugggaaggcaugaucgccggguggcacggauauacgucucauggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcacaacgaaauucucgagcuggaugaaaagguggacgaccuuagagccgauaccaucuccagccaaaucgagcuggcuguccuccugucuaaugaaggcauuaucaacagcgaggacgagcaucuucuggcccucgaacggaaacugaagaagaugcuggggcccuccgcgguggagauuggcaauggauguuucgaaacaaaacacaagugcaaccagaccugccucgaucgcaucgcugccggcacguuugacgccggggaguucucucugccuaccuuugauagccuuaauauuacagcugccucccugaacgacgauggacucgacaaucauaccauccugcuguacuauagcacagcugccucuucccuugcggucacccucaugauugccaucuucgugguuuacauggugagcagagauaacgucucuuguuccaucugccuguga

SEQ ID NO: 211074 - RNA, 1758 nt, Artificial Sequence; identical to SEQ ID NO: 210013
  derived and/or modified sequence opt5 from hemagglutinin__InfluenzaB__AHL93378

SEQ ID NO: 211075 - RNA, 1758 nt, Artificial Sequence
  derived and/or modified sequence opt5 from hemagglutinin__InfluenzaB__AHL93389
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacggaaacccgggggaagcugugucccaaaugccucaacuguacagaucuggacguggcucuuggacgcccuaagugcaccggcaagauucccucugccagagucagcauccugcaugaggugcggccuguuacauccggguguuuucccaucaugcacgaucgcaccaaaauuagacaacucccuaaucugcugcggggauaugaacauauccgccucucuacgcacaacgugauuaaugccgagaacgcuccgggcggccccuacaagaucgggacaagcggauccugcccuaauauuaccaacggcaauggguucuuugccacaauggcuugggccguccccaaaaacgacaagaauaaaaccgcgaccaacccucugacaaucgaagugcccuauauuuguacggagggagaggaucagaucaccguguggggcuuccauagcgacaaugaaacacagauggccaaacuuuacggggauucuaagccgcagaaguuuaccuccagcgcuaacggagucacaacccacuauguuucucaaaucggcggcuucccuaaccagacggaggacgggggacugccccaguccggcagaauugugguggauuacaugguccaaaagagcgggaaaacaggaaccaucaccuaucagcggggcauucuccugccucagaagguguggugcgccucugggcgcuccaaaguuaucaagggaagccuuccccugauuggcgaagcugacugucuccacgagaaauacggcgggcugaauaaguccaagcccuacuauacaggagagcaugccaaagcgaucggcaacugcccuaucugggugaagaccccgcugaaacucgccaaugggacaaaguacagacccccugcuaaacugcuuaaggaacggggauuuuucggcgccauugcuggguuucuggagggcggaugggaaggcaugaucgccggguggcacggauauacgucucauggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcacaacgaaauucucgagcuggaugaaaagguggacgaccuuagagccgauaccaucuccagccaaaucgagcuggcuguccuccugucuaaugaaggcauuaucaacagcgaggacgagcaucuucuggcccucgaacggaaacugaagaagaugcuggggcccuccgcgguggagauuggcaauggauguuucgaaacaaaacacaagugcaaccagaccugccucgaucgcaucgcugccggcacguuugacgccggggaguucucucugccuaccuuugauagccuuaauauuacagcugccucccugaacgacgauggacucgacaaucauaccauccugcuguacuauagcacagcugccucuucccuugcggucacccucaugauugccaucuucgugguuuacauggugagcagagauaacgucucuuguuccaucugccuguga

SEQ ID NO: 211076 - RNA, 1758 nt, Artificial Sequence; identical to SEQ ID NO: 210013
  derived and/or modified sequence opt5 from hemagglutinin__InfluenzaB__AHL93400

SEQ ID NO: 211077 - RNA, 1758 nt, Artificial Sequence; identical to SEQ ID NO: 210346
  derived and/or modified sequence opt5 from hemagglutinin__InfluenzaB__AHL93411

SEQ ID NO: 211078 - RNA, 1758 nt, Artificial Sequence; identical to SEQ ID NO: 210346
  derived and/or modified sequence opt5 from hemagglutinin__InfluenzaB__AHL93422

SEQ ID NO: 211079 - RNA, 1758 nt, Artificial Sequence; identical to SEQ ID NO: 210346
  derived and/or modified sequence opt5 from hemagglutinin__InfluenzaB__AHL93433

SEQ ID NO: 211080 - RNA, 1758 nt, Artificial Sequence; identical to SEQ ID NO: 210013
  derived and/or modified sequence opt5 from hemagglutinin__InfluenzaB__AHL93444

SEQ ID NO: 211081 - RNA, 1758 nt, Artificial Sequence
  derived and/or modified sequence opt5 from hemagglutinin__InfluenzaB__AHL93455
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccaugaacgagcugcauaaugaaauucucgagcuggacgaaaagguggaugaccuuagagccgacaccaucuccagccaaaucgagcuggcuguccuccugucuaacgaaggcauuaucaauagcgaggaugagcaccuucuggcccucgaacggaaacugaagaagaugcuggggcccuccgcgguggagauuggcaacggauguuucgaaacaaaacauaagugcaaucagaccugccucgaccgcaucgcugccggcacguuugaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaacgucucuuguuccaucugccuguga

SEQ ID NO: 211082 - RNA, 1758 nt, Artificial Sequence; identical to SEQ ID NO: 210013
  derived and/or modified sequence opt5 from hemagglutinin__InfluenzaB__AHL93466

SEQ ID NO: 211083 - RNA, 1758 nt, Artificial Sequence; identical to SEQ ID NO: 209632
  derived and/or modified sequence opt5 from hemagglutinin__InfluenzaB__AHL93477

SEQ ID NO: 211084 - RNA, 1758 nt, Artificial Sequence; identical to SEQ ID NO: 209707
  derived and/or modified sequence opt5 from hemagglutinin__InfluenzaB__AHL93488

SEQ ID NO: 211085 - RNA, 1755 nt, Artificial Sequence
  derived and/or modified sequence opt5 from hemagglutinin__InfluenzaB__AHL93499
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaaauccggccugugaccuccggguguuuucccaucaugcacgaccgcacgaagauuagacaacucccuaaucugcugcggggauaugagaacauccgccucucuacacagaauguuauugaugcugaaaaggccccgggcggccccuacagacuggggaccagcggauccugcccuaacgcuacaagcaaaaucggcuucuuugccaccauggcgugggccgugcccaaggacaauuauaaaaacgcuaccaauccucuuacagucgaggugcccuacauuuguacggaaggggaggaucagaucaccguguggggauuccauucugacaacaagacacagaugaaaaaucuguauggcgauuccaacccgcaaaaguuuaccagcucugccaauggggucacagcucacuacguuucccagauuggagacuucccugaucagaccgaggacggcggccucccccagagcgggcggaucgugguggauuauaugaugcaaaagccuggaaaaacgggcacaaucgucuaccagcgcggggugcugcuuccccagaagguuuggugcgccucuggaagauccaaagugauuaagggcagccugccccucaucggggaagcggacugucugcaugagaaauacggaggccugaacaaguccaaaccuuauuacaccggcgaacacgccaaggcuauugggaacugcccgaucugggucaagacaccccucaaacuggccaauggaaccaaguaucggccucccgcuaaacuucugaaggagcgcggcuuuuucggggccauugccggauuucucgagggcgggugggaaggcaugaucgcuggauggcacggcuacaccucucauggggcgcacggaguggccguugcugccgaccugaaaagcacacaggaggccaucaacaagauuacgaagaaucuuaacucccugagcgaacucgaggugaaaaaucugcaaagacugucuggcgcuauggaugaacuccauaacgagauccuggagcuugacgaaaaggucgaugaccugcgggccgauaccauuuccagccagaucgagcucgcggugcugcuuucuaaugaagggauuaucaacagcgaggacgaacaucugcucgcucuggagcgcaaacugaagaaaaugcucggaccuuccgccgucgauaucggcaauggguguuucgagacaaagcacaagugcaaccagaccugccuggacagaauugccgcuggcacauuuaaugccggagaguucucucuucccaccuuugauagccugaacaucacggcugccucccucaaugacgauggccuggacaaccacaccauucugcuuuauuacagcacagcggccucuucccucgcugugacccugaugcuggccaucuucauuguuuauauggugagccgggacaaugucucuuguuccaucugccucuga

SEQ ID NO: 211086 - RNA, 1758 nt, Artificial Sequence; identical to SEQ ID NO: 209632
  derived and/or modified sequence opt5 from hemagglutinin__InfluenzaB__AHL93510

SEQ ID NO: 211087 - RNA, 1755 nt, Artificial Sequence
  derived and/or modified sequence opt5 from hemagglutinin__InfluenzaB__AHL93521
augaaggccaucauugcucugcucaugguggucaccagcaacgccgacagaaucugcacaggcauuacguccucuaauagcccccacguugugaaaaccgcgacacagggggaagugaacgucaccggagugaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaauuggcuucuuugcgaccauggccugggcugugcccaaggacaauuauaaaaacgccaccaauccucuuacagucgaggugcccuacaucuguacggaaggggaggaucagauuaccguguggggauuccauucugacaacaagacacagaugaaaaaucuguauggcgauuccaacccgcaacgguuuaccagcucugcuaauggggucacaacccacuacguuucccagaucggagacuucccugaucagacggaggacggcggccucccccagagcgggcgcauugugguggauuauaugguccaaaagccuggaaagacaggcaccaucguguaccagagagggguucugcuuccccagaaaguguggugcgccucuggacgguccaaggucaucaaaggcagccugccccucauuggggaagcggacugucugcaugagaaguacggaggccugaacaaauccaagccuuauuacaccggcgaacacgccaaagcuaucgggaacugcccgauuugggugaagacaccccucaagcuggccaauggaaccaaauaucgcccucccgcuaagcugcugaaagagagaggcuuuuucggggccaucgccggauuucucgagggcgggugggaaggcaugauugcuggauggcacggcuacacaucucauggggcgcacggaguugccguggcugccgaccuuaagagcacgcaggaggccaucaacaaaaucaccaagaaucuuaacucccugagcgaacucgaggucaagaaucugcaacggcugucuggcgcuauggaugaacuccauaacgagauucuggagcuugacgaaaaaguggaugaccugcgcgccgauacaaucuccagccagauugagcucgcgguccugcuuucuaaugaagggaucauuaacagcgaggacgaacaucugcucgcucuggagagaaagcugaaaaagaugcucggaccuuccgccguggauaucggcaauggguguuucgagaccaaacacaagugcaaccagacaugccuggaccggaucgccgcuggcaccuuuaaugccggagaguucucucuucccacguuugauagccugaacauuaccgcugccucccucaaugacgauggccuggacaaccacacaauccugcuuuauuacagcaccgcggccucuucccucgcuguuacacugaugcuggccauuuucaucguguauauggucagcagagacaaugugucuuguuccauuugccucuga

SEQ ID NO: 211088 - RNA, 1758 nt, Artificial Sequence; identical to SEQ ID NO: 209707
  derived and/or modified sequence opt5 from hemagglutinin__InfluenzaB__AHL93532

SEQ ID NO: 211089 - RNA, 1758 nt, Artificial Sequence; identical to SEQ ID NO: 209669
  derived and/or modified sequence opt5 from hemagglutinin__InfluenzaB__AHL93543

SEQ ID NO: 211090 - RNA, 1758 nt, Artificial Sequence; identical to SEQ ID NO: 209669
  derived and/or modified sequence opt5 from hemagglutinin__InfluenzaB__AHL93554

SEQ ID NO: 211091 - RNA, 1758 nt, Artificial Sequence; identical to SEQ ID NO: 209669
  derived and/or modified sequence opt5 from hemagglutinin__InfluenzaB__AHL93565

SEQ ID NO: 211092 - RNA, 1758 nt, Artificial Sequence; identical to SEQ ID NO: 209707
  derived and/or modified sequence opt5 from hemagglutinin__InfluenzaB__AHL93576

SEQ ID NO: 211093 - RNA, 1758 nt, Artificial Sequence; identical to SEQ ID NO: 209707
  derived and/or modified sequence opt5 from hemagglutinin__InfluenzaB__AHL93587

SEQ ID NO: 211094 - RNA, 1758 nt, Artificial Sequence
  derived and/or modified sequence opt5 from hemagglutinin__InfluenzaB__AHL93609
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggagagcacgccaaagcgauuggcaacugcccgaucugggucaagacaccccugaaacuggccaaugggaccaaguauagaccucccgcuaaacuccugacggaacggggauuuuucggcgccaucgcuggguuucuugagggcggaugggaaggcaugauugccggguggcauggauacaccucucacggcgcccacgggguggcuguugcggccgaucucaagagcacacaggaggcuaucaacaagauuaccaaaaaucugaacucccugagcgaacuugaggugaagaaucugcagcgccucucuggagccauggacgagcugcauaacgaaauccuggagcucgaugaaaaagucgacgaccugagagccgauacaauuuccagccaaaucgagcuugcugugcugcucucuaaugaaggcaucauuaacagcgaggacgagcaucugcuugcccuggaacggaagcucaaaaagaugcuggggccuuccgcggucgagaucggcaauggauguuucgaaaccaagcacaaaugcaaccagacgugccuggaucgcauugcugccggcaccuuugacgccggggaguucucucuccccacauuugauagccugaauaucaccgcugccucccuuaacgacgauggacuggacaaucacacaauucuccuguauuacagcaccgcugccucuucccuggcggugacgcuuaugaucgccauuuucguuguguauauggucagcagagauaacgugucuuguuccaucugccucuga

SEQ ID NO: 211095 - RNA, 1758 nt, Artificial Sequence; identical to SEQ ID NO: 209707
  derived and/or modified sequence opt5 from hemagglutinin__InfluenzaB__AHL93620

SEQ ID NO: 211096 - RNA, 1758 nt, Artificial Sequence; identical to SEQ ID NO: 211094
  derived and/or modified sequence opt5 from hemagglutinin__InfluenzaB__AHL93631

SEQ ID NO: 211097 - RNA, 1758 nt, Artificial Sequence; identical to SEQ ID NO: 211094
  derived and/or modified sequence opt5 from hemagglutinin__InfluenzaB__AHL93642

SEQ ID NO: 211098 - RNA, 1755 nt, Artificial Sequence
  derived and/or modified sequence opt5 from hemagglutinin__InfluenzaB__AHL93653
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaauuggcuucuuugccaccauggcgugggccguccccaaggacaauuauaaaaacgcuaccaauccucuuacaguggaggugcccuacaucuguacggaaggggaggaucagauuaccgucuggggauuccauucugacaacaagacacagaugaaaaaucuguauggcgauuccaacccgcaaaaguuuaccagcucugccaaugggguuacaacccacuacgugucccagaucggagacuucccugaucagacggaggacggcggccucccccagagcgggcggauuguggucgauuauauggugcaaaagccuggaaaaacaggcaccaucguuuaccagcgcggggugcugcuuccccagaaggucuggugcgcuucuggaagauccaaagugaucaagggcagccugccccucauuggggaagccgacugucugcaugagaaauacggaggccugaacaaguccaaaccuuauuacaccggcgaacacgcgaaggccaucggggacugcccgauuuggguuaagacaccccucaaacuggcuaacggaaccaaguaucggccucccgccaaacuucugaaggagcgcggcuuuuucggggcuaucgccggauuucucgagggcgggugggaaggcaugauugccggauggcacggcuacacaucucauggggcucacggaguggcggucgccgcugaucugaaaagcacgcaggaggccaucaauaagaucaccaagaaccuuaauucccugagcgaacucgaggugaaaaaccugcaaagacugucuggcgccauggacgaacuccauaaugagauucuggagcuugaugaaaaggucgacgaucugcgggcugacacaaucuccagccagauugagcucgccgugcugcuuucuaacgaagggaucauuaauagcgaggaugaacaucugcucgcgcuggagcgcaaacugaagaaaaugcucggaccuuccgcuguugacaucggcaacggguguuucgagaccaagcacaagugcaaucagacaugccuggauagaaucgccgccggcaccuuuaacgcuggagaguucucucuucccacguuugacagccugaauauuaccgccgcuucccucaacgaugacggccuggacaaucacacaauccugcuuuauuacagcaccgccgcgucuucccucgccgugacacugaugcuggcuauuuucaucgucuauauggugagccgggauaacguuucuuguuccauuugccucuga

SEQ ID NO: 211099 - RNA, 1758 nt, Artificial Sequence; identical to SEQ ID NO: 209707
  derived and/or modified sequence opt5 from hemagglutinin__InfluenzaB__AHL93664

SEQ ID NO: 211100 - RNA, 1758 nt, Artificial Sequence; identical to SEQ ID NO: 209632
  derived and/or modified sequence opt5 from hemagglutinin__InfluenzaB__AHL93675

SEQ ID NO: 211101 - RNA, 1758 nt, Artificial Sequence; identical to SEQ ID NO: 211094
  derived and/or modified sequence opt5 from hemagglutinin__InfluenzaB__AHL93686

SEQ ID NO: 211102 - RNA, 1758 nt, Artificial Sequence; identical to SEQ ID NO: 211094
  derived and/or modified sequence opt5 from hemagglutinin__InfluenzaB__AHL93697

SEQ ID NO: 211103 - RNA, 1758 nt, Artificial Sequence
  derived and/or modified sequence opt5 from hemagglutinin__InfluenzaB__AHL93708
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccauuaccuaccagcggggcauccugcucccccagaagguuuggugcgccucugggcgcuccaaagugauuaagggaagccugccccuuaucggcgaagcugacugucugcaugagaaauauggcgggcucaauaaguccaagccuuacuacacaggaaaacacgccaaggcgauuggcaacugcccgaucugggucaaaacaccccugaagcuggccaaugggaccaaauauagaccucccgcuaagcuccugacggagcggggauuuuucggcgccaucgcuggguuucuugaaggcggaugggagggcaugauugccggguggcauggauacaccucucacggcgcccacgggguggcuguugcggccgaucucaagagcacacaggaagcuaucaacaaaauuaccaagaaucugaacucccugagcgagcuugaagugaaaaaucugcagcgccucucuggagccauggacgagcugcauaacgagauccuggaacucgaugagaaggucgacgaccugagagccgauacaauuuccagccaaaucgaacuugcugugcugcucucuaaugagggcaucauuaacagcgaagacgagcaucugcuugcccuggagcggaaacucaagaagaugcuggggccuuccgcggucgaaaucggcaauggauguuucgagaccaaacacaagugcaaccagacgugccuggaucgcauugcugccggcaccuuugacgccggggaguucucucuccccacauuugauagccugaauaucaccgcugccucccuuaacgacgauggacuggacaaucacacaauucuccuguauuacagcaccgcugccucuucccuggcggugacgcuuaugaucgccauuuucguuguguauauggucagcagagauaacgugucuuguuccaucugccucuga

SEQ ID NO: 211104 - RNA, 1758 nt, Artificial Sequence
  derived and/or modified sequence opt5 from hemagglutinin__InfluenzaB__AHL93719
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgaggucauuccugugacauccggguguuuucccaucaugcaugaucggaccaaaauucgccaacucccuaaucugcugagaggauacgaacacauccggcucucuacgcauaacguuauuaaugccgagaacgcuccgggcggccccuauaagaucgggacaagcggauccugcccuaauauuaccaacggcaauggguucuuugccacaauggcuugggccgugcccaaaaacgacaagaauaaaaccgcgaccaacccucugacaaucgaaguccccuacaucuguacggagggagaggaucagauuaccguguggggcuuccacagcgacaaugaaacacagauggccaaacuuuauggggauucuaagccgcagaaguuuaccuccagcgcuaacggagugacaacccacuacgucucucaaaucggcggcuucccuaaccagacggaggacgggggacugccccaguccggccgcauuguuguggauuauauggugcaaaagagcgggaaaacaggaaccaucaccuaccagagaggcauucuccugccucagaaggucuggugcgccucugggcgguccaaagugaucaagggaagccuuccccugaucggcgaagcugacugucuccaugagaaauauggcgggcugaauaaguccaagcccuacuacacaggagagcacgccaaagcgauuggcaacugcccuaucuggguuaagaccccgcugaaacucgccaaugggacaaaguauagacccccugcuaaacugcuuaaggaacgcggauuuuucggcgccauugcuggguuucuggagggcggaugggaaggcaugaucgccggguggcauggauacacgucucacggcgcccacgggguggcugucgcggccgaucucaagagcacccaggaggcuauuaacaaaaucacaaagaaucugaacucccuuagcgaacuggaggugaaaaaucuccagcggcugucuggagccauggacgagcugcauaacgaaauccucgagcuggaugaaaagguugacgaccuucgcgccgauaccauuuccagccaaaucgagcuggcugugcuccugucuaaugaaggcauuaucaacagcgaggacgagcaccuucuggcccucgaaagaaaacugaagaagaugcuggggcccuccgcggucgagauuggcaauggauguuucgaaacaaaacauaagugcaaccagaccugccucgaucggaucgcugccggcacguuugacgccggggaguucucucugccuaccuuugauagccuuaauauuacagcugccucccugaacgacgauggacucgacaaucacaccauccugcuguauuacagcacagcugccucuucccuugcggugacccucaugaucgccauuuucgucguguauaugguuagccgcgauaacgugucuuguuccaucugccuguga

SEQ ID NO: 211105 - RNA, 1758 nt, Artificial Sequence; identical to SEQ ID NO: 209707
  derived and/or modified sequence opt5 from hemagglutinin__InfluenzaB__AHL93730

SEQ ID NO: 211106 - RNA, 1758 nt, Artificial Sequence; identical to SEQ ID NO: 209707
  derived and/or modified sequence opt5 from hemagglutinin__InfluenzaB__AHL93741

SEQ ID NO: 211107 - RNA, 1758 nt, Artificial Sequence; identical to SEQ ID NO: 209669
  derived and/or modified sequence opt5 from hemagglutinin__InfluenzaB__AHL93752

SEQ ID NO: 211108 - RNA, 1758 nt, Artificial Sequence; identical to SEQ ID NO: 211094
  derived and/or modified sequence opt5 from hemagglutinin__InfluenzaB__AHL93763

SEQ ID NO: 211109 - RNA, 1758 nt, Artificial Sequence; identical to SEQ ID NO: 209632
  derived and/or modified sequence opt5 from hemagglutinin__InfluenzaB__AHL93774

SEQ ID NO: 211110 - RNA, 1758 nt, Artificial Sequence; identical to SEQ ID NO: 211094
  derived and/or modified sequence opt5 from hemagglutinin__InfluenzaB__AHL93785

SEQ ID NO: 211111 - RNA, 1758 nt, Artificial Sequence; identical to SEQ ID NO: 209707
  derived and/or modified sequence opt5 from hemagglutinin__InfluenzaB__AHL93796

SEQ ID NO: 211112 - RNA, 1758 nt, Artificial Sequence; identical to SEQ ID NO: 209632
  derived and/or modified sequence opt5 from hemagglutinin__InfluenzaB__AHL93818

SEQ ID NO: 211113 - RNA, 1758 nt, Artificial Sequence
  derived and/or modified sequence opt5 from hemagglutinin__InfluenzaB__AHL93829
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaauacagagaacgccccgggcggccccuauaagauugggaccagcggauccugcccuaauaucacaaacggcaauggguucuuugcuaccauggccugggcugugcccaaaaacgacaagaauaaaaccgccacaaacccucugacgauugaaguccccuacaucuguaccgagggagaggaucagaucacaguguggggcuuccacagcgacaaugaaacccagauggcgaaacuuuauggggauucuaagccgcagaaguuuacauccagcgccaacggagugaccacgcacuacgucucucaaauuggcggcuucccuaaccagacagaggacgggggacugccccaguccggcagaaucguuguggauuauauggugcaaaagagcgggaaaaccggaaccauuacauaccagcggggcauccuccugccucagaaggucuggugcgcuucugggcgcuccaaagugauuaagggaagccuuccccugaucggcgaagccgacugucuccaugagaaauauggcgggcugaauaaguccaagcccuacuacaccggagagcacgcuaaagccaucggcaacugcccuauuuggguuaagacaccgcugaaacucgcgaaugggacgaaguauagacccccugccaaacugcuuaaggaacggggauuuuucggcgcuaucgccggguuucuggagggcggaugggaaggcaugauugcuggguggcauggauacaccucucacggcgcccacgggguggccgucgcugcggaucucaagagcacacaggaggccaucaacaaaauuaccaagaaucugaacucccuuagcgaacuggaggugaaaaaucuccagcgccugucuggagcuauggacgagcugcauaacgaaauccucgagcuggaugaaaagguugacgaccuuagagccgauacaaucuccagccaaauugagcuggccgugcuccugucuaaugaaggcaucauuaacagcgaggacgagcaccuucuggcucucgaacggaaacugaagaagaugcuggggcccuccgccgucgagaucggcaauggauguuucgaaaccaaacauaagugcaaccagacgugccucgaucgcauugcggcuggcaccuuugacgccggggaguucucucugccuacauuugauagccuuaauaucaccgccgcuucccugaacgacgauggacucgacaaucacacaauucugcuguauuacagcaccgccgcuucuucccuugccgugacgcucaugaucgcgaucuucgucguguauaugguuagcagagauaacgugucuuguuccauuugccuguga

SEQ ID NO: 211114 - RNA, 1758 nt, Artificial Sequence; identical to SEQ ID NO: 210013
  derived and/or modified sequence opt5 from hemagglutinin__InfluenzaB__AHL93840

SEQ ID NO: 211115 - RNA, 1758 nt, Artificial Sequence; identical to SEQ ID NO: 209707
  derived and/or modified sequence opt5 from hemagglutinin__InfluenzaB__AHL93851

SEQ ID NO: 211116 - RNA, 1758 nt, Artificial Sequence; identical to SEQ ID NO: 209707
  derived and/or modified sequence opt5 from hemagglutinin__InfluenzaB__AHL93862

SEQ ID NO: 211117 - RNA, 1758 nt, Artificial Sequence
  derived and/or modified sequence opt5 from hemagglutinin__InfluenzaB__AHL93873
augaaggccaucauugugcugcucauggucguuaccagcaacgcugacagaaucugcacaggcauuacguccucuaauagcccccacaucgugaaaaccgccacacagggggaagugaacgucaccggagugauuccucugacaaccacaccgaccaagucccauuucgcgaaucuuaaaggcacggaaacccgcggggagcugugucccaagugccucaacuguacagaucuggacguugcucuuggacggccuaaaugcaccggcaagauccccucugccagagugagcauccugcacgaaguccggccugugacauccggguguuuucccauuaugcaugaucgcaccaagaucagacaacucccuaaucugcugcggggauacgagcacauucgccucucuacgcauaacguuaucaaugccgaaaacgcuccgggcggccccuauaaaauugggacaagcggauccugcccuaauaucaccaacggcaauggguucuuugccacaauggcuugggccgugcccaagaacgacaaaaauaagaccgcgaccaacccucugacaauugagguccccuacaucuguacggagggagaagaucagaucaccguguggggcuuccacagcgacaaugagacacagauggccaaacuuuauggggauucuaagccgcagaaguuuaccuccagcgcuaacggagugacaacccacuacgucucucaaauuggcggcuucccuaaccagacggaagacgggggacugccccaguccggcagaaucguuguggauuauauggugcagaaaagcgggaagacaggaaccauuaccuaccaacggggcauccuccugccucagaaagucuggugcgccucugggcgcuccaaggugauuaaaggaagccuuccccugaucggcgaggcugacugucuccaugagaaguauggcgggcugaauaaauccaagcccuacuacacaggagaacacgccaaggcgaucggcaacugcccuauuuggguuaaaaccccgcugaagcucgccaaugggacaaaauauagacccccugcuaagcugcuuaaagagcggggauuuuucggcgccaucgcuggguuucuggaaggcggaugggagggcaugauugccggguggcauggauacacgucucacggcgcccacgggguggcugucgcggccgaucucaagagcacccaggaagcuaucaacaagauuaccaaaaaucugaacucccuuagcgagcuggaggugaagaaucuccagcgccugucuggagccauggacgaacugcauaacgagauccucgaacuggaugagaaaguugacgaccuuagagccgauacaaucuccagccaaauugaacuggcugugcuccugucuaaugagggcaucauuaacagcgaggacgaacaccuucuggcccucgagcggaagcugaaaaagaugcuggggcccuccgcggucgaaaucggcaauggauguuucgagacaaagcauaaaugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccaucuucgucguguauaugguuagcagagauaacgugucuuguuccauuugccuguga

SEQ ID NO: 211118 - RNA, 1758 nt, Artificial Sequence; identical to SEQ ID NO: 209707
  derived and/or modified sequence opt5 from hemagglutinin__InfluenzaB__AHL93884

SEQ ID NO: 211119 - RNA, 1758 nt, Artificial Sequence; identical to SEQ ID NO: 209707
  derived and/or modified sequence opt5 from hemagglutinin__InfluenzaB__AHL93895

SEQ ID NO: 211120 - RNA, 1758 nt, Artificial Sequence; identical to SEQ ID NO: 209707
  derived and/or modified sequence opt5 from hemagglutinin__InfluenzaB__AHL93906

SEQ ID NO: 211121 - RNA, 1758 nt, Artificial Sequence; identical to SEQ ID NO: 209707
  derived and/or modified sequence opt5 from hemagglutinin__InfluenzaB__AHL93917

SEQ ID NO: 211122 - RNA, 1758 nt, Artificial Sequence; identical to SEQ ID NO: 209632
  derived and/or modified sequence opt5 from hemagglutinin__InfluenzaB__AHL93928

SEQ ID NO: 211123 - RNA, 1758 nt, Artificial Sequence; identical to SEQ ID NO: 209669
  derived and/or modified sequence opt5 from hemagglutinin__InfluenzaB__AHL93939

SEQ ID NO: 211124 - RNA, 1758 nt, Artificial Sequence; identical to SEQ ID NO: 209707
  derived and/or modified sequence opt5 from hemagglutinin__InfluenzaB__AHL93950

SEQ ID NO: 211125 - RNA, 1758 nt, Artificial Sequence; identical to SEQ ID NO: 209669
  derived and/or modified sequence opt5 from hemagglutinin__InfluenzaB__AHL93961

SEQ ID NO: 211126 - RNA, 1758 nt, Artificial Sequence
  derived and/or modified sequence opt5 from hemagglutinin__InfluenzaB__AHL93972
augaaggccaucauugugcugcucauggucguuaccagcacagcugacagaaucugcacgggcauuaccuccucuaacagcccccacguggugaaaacagccacccagggggaggucaaugugacaggaguuaucccucugaccacaaccccgacgaagucccauuucgcgaaccuuaaaggcaccgaaacacgggggaagcugugucccaaaugccucaauuguaccgaucuggacguggcucuuggacgcccuaagugcacaggcaagauucccucugccagagucagcauccugcacgaggugcggccuguuaccuccggguguuuucccaucaugcaugaucgcacgaaaauuagacaacucccuaaccugcugcggggauacgaacacauccgccucucuacacauaaugugauuaacgccgagaaugcuccgggcggccccuauaagaucgggaccagcggauccugcccuaacgucacaaauggcaacggguucuuugccaccauggcuugggccgugcccaaaaaugacaagaacaaaaccgcgacaaauccucugacgauugaagugcccuacaucuguaccgagggagaggaucagauuacagucuggggcuuccacagcgacaacgaaacccagauggccaagcuguauggggauucuaagccgcagaaauuuacauccagcgcuaauggaguuaccacgcacuacgugucucaaaucggcggcuucccuaaccagacagaggacgggggacugccccaguccggcagaaucguggucgauuauauggugcaaaagagcgggaaaaccggaaccauuacauaccagcggggcauccuccugccucagaagguuuggugcgccucugggcgcuccaaagugauuaagggaagccuuccccugaucggcgaagcugacugucuccaugagaaauauggcgggcugaacaaguccaagcccuacuacaccggagagcacgccaaagcggucggcaauugcccuauuugggugaagacaccgcugaaacucgccaacgggacgaaguauagacccccugcuaaacugcuuaaggaacggggauuuuucggcgccaucgcuggguuucuggagggcggaugggaaggcaugaucgccggguggcauggauacaccucucacggcgcccacgggguugcuguggcggccgaucucaagagcacacaggaggcuauuaauaaaaucaccaagaaccuuaauucccuuagcgaacuggaggucaaaaaccuccagcgccugucuggagccauggacgagcugcauaaugaaauucucgagcuggaugaaaagguggacgaccuuagagccgauacaaucuccagccaaauugagcuggcuguccuccugucuaacgaaggcaucaucaauagcgaggacgagcaccuucuggcccucgaacggaaacugaagaagaugcuggggcccuccgcgguggagauuggcaacggauguuucgaaaccaaacauaagugcaaucagacgugccucgaucgcaucgcugccggcaccuuugacgccggggaguucucucugccuacauuugauagccuuaacauuaccgcugccucccugaaugacgauggacucgacaaccacacaauccugcuguauuacagcaccgcugccucuucccuugcgguuacgcucaugauugccaucuucguggucuauauggugagcagagauaauguuucuuguuccauuugccuguga

SEQ ID NO: 211127 - RNA, 1758 nt, Artificial Sequence; identical to SEQ ID NO: 209632
  derived and/or modified sequence opt5 from hemagglutinin__InfluenzaB__AHL93983

SEQ ID NO: 211128 - RNA, 1755 nt, Artificial Sequence
  derived and/or modified sequence opt5 from hemagglutinin__InfluenzaB__AHL93994
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaagaaauccuacuucgcgaaucuuaagggcaccaaaacgcgggggaagcugugucccgauugccucaacuguaccgaccuggauguggcucuuggacgcccuaugugcgucggcacaacccccucugccaaggccagcauucugcaugaagugagaccuguuacauccggguguuuucccaucaugcacgaccggaccaaaauccgccaacucgcuaaucugcugagaggauaugagaacauucggcucucuacgcagaaugugaucgaugccgaaaaggcuccuggcggcccguaccgccuggggacaagcggauccugccccaacgccaccagcaaaucuggcuucuuugcgacaauggccugggcugucccuaaggacaauaacaaaaaugccaccaacccccuuaccguggaggugccuuauauuugugcugaaggggaggaucagaucacagucuggggauuccauuccgacaauaagacgcagaugaagaaccuguacggcgauagcaauccccaaaaauuuaccucuuccgccaacgggguuacaacccacuaugugagccagauuggaggcuucccggaccagacagaggauggcgggcucccucagucuggaagaaucguggucgacuacaugaugcaaaagcccggcaaaaccgggacgauuguguaucagcggggaguucugcuuccucagaagguguggugcgcguccggccgcagcaaagucaucaaggggucccugccccucaucggagaagccgauugucugcaugagaaauacggcggccugaacaagucuaagcccuacuauacaggggaacacgcuaaagccauuggaaauugcccuaucugggugaagaccccgcucaaacuggcuaacggcaccaaguacagacccccugccaaacuucugaaggagcggggguuuuucggagccauugcuggcuuucucgaagggggcugggaaggaaugaucgcgggcuggcacggguauacaagccauggagcccacggcguugcuguggccgccgaccugaaguccacccaggaggcuauuaauaaaaucacaaagaaccuuaauagccugucugaacucgaggucaaaaaccugcaacgccuguccggggccauggacgaacuccauaaugagauccuggagcuugaugaaaagguggacgaucugagagcggacacgauuagcucucagaucgagcucgcuguccugcuuagcaacgaaggaauuaucaauuccgaggaugaacaucugcucgcccuggagcggaaacugaagaagaugcucggccccucugccguggacauugggaacggcuguuucgagaccaaacacaagugcaaucagacaugccuggaucgcaucgcugccggaaccuuuaacgcuggcgaguucagccuuccuacauuugacucccugaauaucaccgccgcgagccucaacgaugacgggcuggauaaucacacgauucugcuuuacuauucuaccgccgcuuccagccucgccguuacacugaugcuggcuaucuucauuguguacaugaucucuagagacaacgucuccuguagcauuugccucuga

SEQ ID NO: 211129 - RNA, 1758 nt, Artificial Sequence; identical to SEQ ID NO: 209707
  derived and/or modified sequence opt5 from hemagglutinin__InfluenzaB__AHL94005

SEQ ID NO: 211130 - RNA, 1758 nt, Artificial Sequence; identical to SEQ ID NO: 209707
  derived and/or modified sequence opt5 from hemagglutinin__InfluenzaB__AHL94016

SEQ ID NO: 211131 - RNA, 1758 nt, Artificial Sequence
  derived and/or modified sequence opt5 from hemagglutinin__InfluenzaB__AHL94027
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacaacccacuacgucucucaaauuggcggcuucccuaaccagacggaggacgggggacugccccaguccggcagaaucguuguggauuauauggugcaaaagagcgggaaaacaggaaccauuaccuaccagaugggcguccuccugccucagaagguguggugcgccucugggcgguccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacgcggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcggcugucuggagccauggacgagcugcauaacgaaauucucgagcuggaugaaaagguggacgaccuucgcgccgauaccaucuccagccaaaucgagcuggcuguccuccugucuaaugaaggcauuaucaacagcgaggacgagcaccuucuggcccucgaaagaaaacugaagaagaugcuggggcccuccgcgguggagauuggcaauggauguuucgaaacaaaacauaagugcaaccagaccugccucgaucggaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugauugccaucuucgugguuuauauggugagccgcgauaacgucucuuguuccaucugccuguga

SEQ ID NO: 211132 - RNA, 1758 nt, Artificial Sequence; identical to SEQ ID NO: 209669
  derived and/or modified sequence opt5 from hemagglutinin__InfluenzaB__AHL94038

SEQ ID NO: 211133 - RNA, 1758 nt, Artificial Sequence; identical to SEQ ID NO: 209632
  derived and/or modified sequence opt5 from hemagglutinin__InfluenzaB__AHL94049

SEQ ID NO: 211134 - RNA, 1758 nt, Artificial Sequence; identical to SEQ ID NO: 209707
  derived and/or modified sequence opt5 from hemagglutinin__InfluenzaB__AHL94060

SEQ ID NO: 211135 - RNA, 1758 nt, Artificial Sequence
  derived and/or modified sequence opt5 from hemagglutinin__InfluenzaB__AHL94071
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacaacccacuacgucucucaaauuggcggcuucccuaaccagacggaggacgggggacugccccaguccggcagaaucguuguggauuauaugaugcaaaagagcgggaaaacaggaaccauuaccuaccagcggggcauccuccugccucagaagguguggugcgccucugggcgcuccaaagucauuaagggaagccuuccccugaucggcgaagcugacugucuccaugagaaauauggcgggcugaauaaguccaagcccuacuacacaggagagcacgccaaagcgaucggcaacugcccuauuugggugaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguugcuguggcggccgaucucaagagcacccaggaggcuaucuccaaaauuacaaagaaccugaauagccuuucugaacuggaggucaaaaaccuccagcgccuguccggagccauggacgagcugcauaaugaaauccucgagcuggaugaaaagguggacgaccuuagagccgauaccaucagcucucaaauugagcuggcuguucuccugagcaacgaaggcaucauuaauuccgaggacgagcaccuucuggcccucgaacggaaacugaagaagaugcuggggcccucugcgguggagaucggcaacggauguuucgaaacaaaacauaagugcaaucagaccugccucgaucgcauugcugccggcacguuugacgccggggaguucagccugccuaccuuugauucccuuaacaucacagcugccagccugaaugacgauggacucgacaaccacaccauucugcuguauuacucuacagcugccuccagccuugcggucacccucaugaucgccaucuucguggucuauauggugucuagagauaauguuuccuguagcauuugccuguga

SEQ ID NO: 211136 - RNA, 1755 nt, Artificial Sequence
  derived and/or modified sequence opt5 from hemagglutinin__InfluenzaB__AHL94082
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaaauccggccugugaccuccggguguuuucccaucaugcacgaccgcacgaagauuagacaacucccuaaucugcugcggggauaugagaacauccgccucucuacacagaauguuauugaugcugaaaaggccccgggcggccccuacagacuggggaccagcggauccugcccuaacgcuacaagcaaaaucggcuucuuugccaccauggcgugggccgugcccaaggacaauuauaaaaacgcuaccaauccucuuacagucgaggugcccuacauuuguacggaaggggaggaucagaucaccguguggggauuccauucugacaacaagacacagaugaaaaaucuguauggcgauuccaacccgcaaaaguuuaccagcucugccaauggggucacaacccacuacguuucccagauuggagacuucccugaucagacggaggacggcggccucccccagagcgggcggaucgugguggauuauaugaugcaaaagccuggaaaaacaggcaccaucgucuaccagcgcggggugcugcuuccccagaagguuuggugcgcuucuggaagauccaaagugauuaagggcagccugccccucaucggggaagccgacugucugcaugagaaauacggaggccugaacaaguccaaaccuuauuacaccggcgaacacgcgaaggccauugggaacugcccgaucugggucaagacaccccucaaacuggcuaauggaaccaaguaucggccucccgccaaacuucugaaggagcgcggcuuuuucggggcuauugccggauuucucgagggcgggugggaaggcaugaucgccggauggcacggcuacacaucucauggggcucacggaguggcgguugccgcugaccugaaaagcacgcaggaggccaucaacaagauuaccaagaaucuuaacucccugagcgaacucgaggugaaaaaucugcaaagacugucuggcgccauggaugaacuccauaacgagauccuggagcuugacgaaaaggucgaugaccugcgggcugauacaauuuccagccagaucgagcucgccgugcugcuuucuaaugaagggauuaucaacagcgaggacgaacaucugcucgcgcuggagcgcaaacugaagaaaaugcucggaccuuccgcugucgauaucggcaauggguguuucgagaccaagcacaagugcaaccagacaugccuggacagaauugccgccggcaccuuuaaugcuggagaguucucucuucccacguuugauagccugaacaucaccgccgcuucccucaaugacgauggccuggacaaccacacaauucugcuuuauuacagcaccgccgcgucuucccucgccgugacacugaugcuggcuaucuucauuguuuauauggugagccgggacaaugucucuuguuccaucugccucuga

SEQ ID NO: 211137 - RNA, 1758 nt, Artificial Sequence; identical to SEQ ID NO: 209669
  derived and/or modified sequence opt5 from hemagglutinin__InfluenzaB__AHL94093

SEQ ID NO: 211138 - RNA, 1758 nt, Artificial Sequence; identical to SEQ ID NO: 209707
  derived and/or modified sequence opt5 from hemagglutinin__InfluenzaB__AHL94102

SEQ ID NO: 211139 - RNA, 1758 nt, Artificial Sequence
  derived and/or modified sequence opt5 from hemagglutinin__InfluenzaB__AHL94113
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugccugaauaucaccaacggcaauggguucuuugccacaauggcuugggccgugccuaaaaacgacaagaauaaaaccgcgaccaacccccuuacaauugaagucccuuacaucuguacggagggagaggaucagaucaccguguggggcuuccacagcgacaaugaaacacagauggccaagcuguauggggauucuaagccccagaaauuuaccuccagcgcuaacggagugacaacccacuacgucucucaaauuggcggcuucccgaaccagacggaggacgggggacucccucaguccggcagaaucguuguggauuauauggugcaaaagagcgggaaaacaggaaccauuaccuaccagcggggcauccugcuuccccagaaggucuggugcgccucugggcgcuccaaagugauuaagggaagccugccucucaucggcgaagcugacugucugcaugagaaauauggcgggcugaauaaguccaagcccuacuacacaggagagcacgccaaagcgaucggcaacugccccauuuggguuaagaccccucucaaacuggccaaugggacaaaguauagaccgcccgcuaaacuucugaaggaacggggauuuuucggcgccaucgcuggguuucucgagggcggaugggaaggcaugauugccggguggcauggauacacgucucacggcgcccacgggguggcugucgcggccgaucuuaagagcacccaggaggcuaucaacaaaauuacaaagaaucugaacucccugagcgaacucgaggugaaaaaucugcagcgccugucuggagccauggacgagcuccauaacgaaauccuggagcuugaugaaaagguugacgaccugagagccgauaccaucuccagccaaauugagcucgcugugcugcuuucuaaugaaggcaucauuaacagcgaggacgagcaucugcucgcccuggaacggaaacugaagaagaugcucgggccuuccgcggucgagaucggcaauggauguuucgaaacaaaacacaagugcaaccagaccugccuggaucgcauugcugccggcacguuugacgccggggaguucucucuucccaccuuugauagccugaauaucacagcugccucccucaacgacgauggacuggacaaucacaccauucugcuuuauuacagcacagcugccucuucccucgcggugacccugaugaucgccaucuucgucguguauaugguuagcagagauaacgugucuuguuccauuugccuguga

SEQ ID NO: 211140 - RNA, 1758 nt, Artificial Sequence
  derived and/or modified sequence opt5 from hemagglutinin__InfluenzaB__AHL94124
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagauucggccugucacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguucccaaaaacgacaagaauaaaaccgcgaccaacccucugacaaucgaagugcccuacaucuguacggagggagaggaucagauuaccgucuggggcuuccacagcgacaaugaaacacagauggccaaacuuuauggggauucuaagccgcagaaguuuaccuccagcgcuaacggagugacaacccacuacgugucucaaaucggcggcuucccuaaccagacggaggacgggggacugccccaguccggcagaauugucguugauuauauggugcaaaagagcgggaaaacaggaaccaucaccuaccagcggggcauucuccugccucagaagguguggugcgccucugggcgcuccaaagucaucaagggaagccuuccccugaucggcgaagcugacugucuccaugagaaauauggcgggcugaauaaguccaagcccuacuacacaggagagcacgccaaagcgauuggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacgggguugcuguggcggccgaucucaagagcacccaggaggcuauuaacaaaaucacaaagaaucugaacucccuuagcgaacuggaggucaaaaaucuccagcgccugucuggagccauggacgagcugcauaacgaaauccucgagcuggaugaaaagguggacgaccuuagagccgauaccauuuccagccaaaucgagcuggcuguucuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugaucgccauuuucguggucuauauggugagcagagauaacguuucuuguuccaucugccuguga

SEQ ID NO: 211141 - RNA, 1758 nt, Artificial Sequence; identical to SEQ ID NO: 209632
  derived and/or modified sequence opt5 from hemagglutinin__InfluenzaB__AHL94135

SEQ ID NO: 211142 - RNA, 1758 nt, Artificial Sequence; identical to SEQ ID NO: 209632
  derived and/or modified sequence opt5 from hemagglutinin__InfluenzaB__AHL94146

SEQ ID NO: 211143 - RNA, 1758 nt, Artificial Sequence; identical to SEQ ID NO: 209707
  derived and/or modified sequence opt5 from hemagglutinin__InfluenzaB__AHL94157

SEQ ID NO: 211144 - RNA, 1758 nt, Artificial Sequence; identical to SEQ ID NO: 209707
  derived and/or modified sequence opt5 from hemagglutinin__InfluenzaB__AHL94168

SEQ ID NO: 211145 - RNA, 1758 nt, Artificial Sequence; identical to SEQ ID NO: 209632
  derived and/or modified sequence opt5 from hemagglutinin__InfluenzaB__AHL94179

SEQ ID NO: 211146 - RNA, 1758 nt, Artificial Sequence; identical to SEQ ID NO: 209632
  derived and/or modified sequence opt5 from hemagglutinin__InfluenzaB__AHL94190

SEQ ID NO: 211147 - RNA, 1758 nt, Artificial Sequence
  derived and/or modified sequence opt5 from hemagglutinin__InfluenzaB__AHL94201
augaaggccaucauugugcugcucauggucguuaccagcaacgcugacagaaucugcacaggcauuacguccucuaauagcccccacaucgugaaaaccgccacacagggggaagugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugaaacaauggccugggcugugcccaaaaacgacaagaauaaaaccgccaccaacccucugacaauugagguccccuacaucuguacggagggagaagaucagaucaccguguggggcuuccacagcgacaaugagacacagauggcgaaacuuuauggggauucuaagccgcagaaguuuaccuccagcgccaacggagugacaacccacuacgucucucaaauuggcggcuucccuaaccagacggaagacgggggacugccccaguccggcagaaucguuguggauuauauggugcaaaagagcgggaaaacaggaaccauuaccuaccagcggggcauccuccugccucagaaggucuggugcgcuucugggcgcuccaaagugauuaagggaagccuuccccugaucggcgaggccgacugucuccaugagaaauauggcgggcugaauaaguccaagcccuacuacacaggagaacacgcuaaagccaucggcaacugcccuauuuggguuaagaccccgcugaaacucgcgaaugggacaaaguauagacccccugccaaacugcuuaaggagcggggauuuuucggcgcuaucgccggguuucuggaaggcggaugggagggcaugauugcuggguggcauggauacacgucucacggcgcccacgggguggccgucgcugcggaucucaagagcacccaggaagccaucaacaaaauuacaaagaaucugaacucccuuagcgagcuggaggugaaaaaucuccagcgccugucuggagcuauggacgaacugcauaacgagauccucgaacuggaugagaagguugacgaccuuagagccgauaccaucuccagccaaauugaacuggccgugcuccugucuaaugagggcaucauuaacagcgaggacgaacaccuucuggcucucgagcggaaacugaagaagaugcuggggcccuccgccgucgaaaucggcaauggauguuucgagacaaaacauaagugcaaccagaccugccucgaucgcauugcggcuggcacguuugacgccggggaguucucucugccuaccuuugauagccuuaauaucacagccgcuucccugaacgacgauggacucgacaaucacaccauucugcuguauuacagcacagccgcuucuucccuugccgugacccucaugaucgcgaucuucgucguguauaugguuagcagaaacaacgugucuuguuccauuugccuguga

SEQ ID NO: 211148 - RNA, 1758 nt, Artificial Sequence
  derived and/or modified sequence opt5 from hemagglutinin__InfluenzaB__AHL94212
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucaggucaccguuuggggcuuccacagcgacaaugaaacacagauggccaaacuuuauggggauucuaagccgcagaaguuuaccuccagcgcuaacggagugacaacccacuacgugucucaaauuggcggcuucccuaaccagacggaggacgggggacugccccaguccggcagaaucgucguggauuauaugguucaaaagagcgggaaaacaggaaccaucaccuaccagcggggcauucuccugccucagaagguguggugcgccucugggcgcuccaaagucaucaagggaagccuuccccugauuggcgaagcugacugucuccaugagaaauauggcgggcugaauaaguccaagcccuacuacacaggagagcacgccaaagcgaucggcaacugcccuauuugggugaagaccccgcugaaacucgccaaugggacaaaguauagacccccugcuaaacugcuuaaggaacggggauuuuucggcgccaucgcuggguuucuggagggcggaugggaaggcaugaucgccggguggcauggauacacgucucacggcgcccacgggguugcuguggcggccgaucucaagagcacccaggaggcuauuaacaaaaucacaaagaaucugaacucccuuagcgaacuggaggucaaaaaucuccagcgccugucuggagccauggacgagcugcauaacgaaauucucgagcuggaugaaaagguggacgaccuuagagccgauaccaucuccagccaaauugagcuggcuguccuccugucuaaugaaggcaucaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcgguuacccucaugauugccaucuucguggucuauauggugagcagagauaacguuucuuguuccauuugccuguga

SEQ ID NO: 211149 - RNA, 1758 nt, Artificial Sequence; identical to SEQ ID NO: 209707
  derived and/or modified sequence opt5 from hemagglutinin__InfluenzaB__AHL94220

SEQ ID NO: 211150 - RNA, 1758 nt, Artificial Sequence; identical to SEQ ID NO: 209707
  derived and/or modified sequence opt5 from hemagglutinin__InfluenzaB__AHL94231

SEQ ID NO: 211151 - RNA, 1758 nt, Artificial Sequence
  derived and/or modified sequence opt5 from hemagglutinin__InfluenzaB__AHL94242
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccaaugggcgcucuaaagugauuaagggaucccuuccccugaucggcgaagcugacugucuccaugagaaauauggcgggcugaacaagagcaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucccacggcgcccacgggguggcuguugcggccgaucucaagucuacccaggaggcuaucaauaaaauuacaaagaaccugaauagccuuuccgaacuggaggugaaaaaccuccagcgccugagcggagccauggacgagcugcauaaugaaauccucgagcuggaugaaaaggucgacgaccuuagagccgauaccauuucuucccaaaucgagcuggcugugcuccugagcaacgaaggcaucauuaauucugaggacgagcaccuucuggcccucgaacggaaacugaagaagaugcuggggcccagcgcggucgagaucggcaacggauguuucgaaacaaaacauaagugcaaucagaccugccucgaucgcauugcugccggcacguuugacgccggggaguucucccugccuaccuuugauucucuuaacaucacagcugccagccugaaugacgauggacucgacaaccacaccauucugcuguauuacuccacagcugccagcucucuugcggugacccucaugaucgccauuuucguuguguauauggucuccagagauaacgugagcuguucuaucugccuguga

SEQ ID NO: 211152 - RNA, 1758 nt, Artificial Sequence; identical to SEQ ID NO: 209669
  derived and/or modified sequence opt5 from hemagglutinin__InfluenzaB__AHL94253

SEQ ID NO: 211153 - RNA, 1755 nt, Artificial Sequence
  derived and/or modified sequence opt5 from hemagglutinin__InfluenzaB__AHL94274
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaauaaaacacagaugaagucccuguauggcgauagcaacccgcaaaaguuuaccucuuccgccaaugggguuacaacccacuacgugagccagaucggagacuucccugaucagacggaggacggcggccucccccagucugggcggauuguggucgauuauaugaugcaaaaaccuggaaagacaggcaccaucguguaccagcgcgggguucugcuuccccagaaaguguggugcgcuuccggaagaagcaaggucaucaaaggcucccugccccucauuggggaagccgacugucugcaugaggaauacggaggccugaacaagucuaaaccuuauuacaccggcaagcacgcgaaggccaucgggaauugcccgauuugggugaaaacaccccucaagcuggcuaacggaaccaaauaucggccucccgccaagcugcugaaagagcgcggcuuuuucggggcuaucgccggauuucucgagggcgggugggaaggcaugauugccggauggcacggcuacacaagccauggggcucacggaguugcgguggccgcugaccugaaguccacgcaggaggccaucaacaagaucaccaaaaaucuuaacagccugucugaacucgaggucaagaaucugcaaagacuguccggcgccauggaugaacuccauaacgagauucuggagcuugacgaaaaaguggaugaccugcgggcugauacaaucagcucucagauugagcucgccguccugcuuagcaaugaagggaucauuaacuccgaggacgaacaccuucucgcgcuggagcgcaagcugaaaaagaugcucggaccuucugcuguggauaucggcaauggguguuucgagaccaagcacaaaugcaaccagacaugccuggacagaaucgccgccggcaccuuuaaugcuggagaguucagccuucccacguuugauucccugaacauuaccgccgcuagccucaaugacgauggccuggacaaccauacaauccugcuuuauuacucuaccgccgcguccagccucgccguuacacugaugcuggcuauuuucaucguguauauggucucucgggacaauguguccuguagcauuugccucuga

SEQ ID NO: 211154 - RNA, 1755 nt, Artificial Sequence; identical to SEQ ID NO: 211153
  derived and/or modified sequence opt5 from hemagglutinin__InfluenzaB__AHL94295

SEQ ID NO: 211155 - RNA, 1755 nt, Artificial Sequence
  derived and/or modified sequence opt5 from hemagglutinin__InfluenzaB__AHL94306
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaauuggcuucuuugcgaccauggccugggcugugcccaaggacaauuauaaaaacgccaccaauccucagacagucgaggugcccuacaucuguacggaaggggaggaucagauuaccguguggggauuccauucugacaacaagacacaaaugaaaaaucuuuauggcgauuccaacccgcagaaguuuaccagcucugcuaauggggucacaacccacuacguuucccagaucggagacuucccugaucagacggaggacggcggccugccccaaagcgggcggauugugguggauuauaugguccagaagccuggaaaaacaggcaccaucguguaccagcgcgggguucuccugccccagaagguguggugcgccucuggaagauccaaagucaucaagggcagccuuccccugauuggggaagcggacugucuccaugagaaauacggaggccugaacaaguccaaaccuuauuacaccggcgaacacgccaaggcuaucgggaacugcccgauuugggugaagacaccccugaaacucgccaauggaaccaaguaucggccucccgcuaaacugcuuaaggagcgcggcuuuuucggggccaucgccggauuucuggagggcgggugggaaggcaugauugcuggauggcacggcuacacaucucauggggcgcacggaguugccguggcugccgaccucaaaagcacgcaagaggccaucaacaagaucaccaagaaucugaacucccuuagcgaacuggaggucaaaaaucuccagagacugucuggcgcuauggaugaacugcauaacgagauucucgagcuggacgaaaagguggaugaccuucgggccgauacaaucuccagccagauugagcuggcgguccuccugucuaaugaagggaucauuaacagcgaggacgaacaccuucuggcucucgagcgcaaacugaagaaaaugcugggaccuuccgccguggauaucggcaauggguguuucgagaccaagcacaagugcaaccaaacaugccucgacagaaucgccgcuggcaccuuuaaugccggagaguucucucugcccacguuugauagccuuaacauuaccgcugccucccugaaugacgauggccucgacaaccauacaauccugcuguauuacagcaccgcggccucuucccuugcuguuacacucaugcuggccauuuucaucguguauauggucagccgggacaaugugucuuguuccauuugccuguga

SEQ ID NO: 211156 - RNA, 1755 nt, Artificial Sequence
  derived and/or modified sequence opt5 from hemagglutinin__InfluenzaB__AHL94317
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaaguccuacuucgcuaaucuuaaaggcauucggacgcgcgggaagcugugucccgauugccucaacuguaccgaccuggauguugcccuuggaagaccuaugugcgugggcacaacccccucugccaaagcuagcauccugcaugaaguccggccugugacauccggguguuuucccaucaugcacgaccgcaccaagauuagacaacucccuaaucugcugcggggauaugagaacauccgccucucuacgcagaauguuauugaugccgaaaaggcuccgggcggccccuacagacuggggacaagcggauccugcccuaacgccaccagcaaaaucggcuucuuugcgacaauggccugggcugugccccgggacaauuauaagaacgccaccaauccucagaccgucgaggugcccuacauuuguacagaaggggaggaucagaucacgguguggggauuccauucugacaacaaaacccaaaugaagaaucuuuauggcgauuccaacccgcagaaauuuacaagcucugcuaauggggucaccacacacuacguuucccagauuggagacuucccugaucagaccgaggacggcggccugccccaaagcgggcgcaucgugguggauuauaugguccagaagccuggaaagacgggcacaaucguguaccagagagggguucuccugccccagaaaguguggugcgccucuggacgguccaaggucauuaaaggcagccuuccccugaucggggaagcggacugucuccaugagaaguacggaggccugaacaaauccaagccuuauuacaccggcgaacacgccaaagcuauugggaacugcccgaucugggugaagacaccccugaagcucgccaauggaaccaaauaucgcccucccgcuaagcugcuuaaagagagaggcuuuuucggggccauugccggauuucuggagggcgggugggaaggcaugaucgcuggauggcacggcuacaccucucauggggcgcacggaguugccguggcugccgaccucaagagcacacaagaggccaucaacaaaauuacgaagaaucugaacucccuuagcgaacuggaggucaagaaucuccagcggcugucuggcgcuauggaugaacugcauaacgagauccucgagcuggacgaaaaaguggaugaccuucgcgccgauaccauuuccagccagaucgagcuggcgguccuccugucuaaugaagggauuaucaacagcgaggacgaacaccuucuggcucucgagagaaagcugaaaaagaugcugggaccuuccgccguggauaucggcaauggguguuucgagacaaaacacaagugcaaccaaaccugccucgaccggauugccgcuggcacauuuaaugccggagaguucucucugcccaccuuugauagccuuaacaucacggcugccucccugaaugacgauggccucgacaaccauaccauucugcuguauuacagcacagcggccucuucccuugcuguuacccucaugcuggccaucuucauuguguauauggucagcagagacaaugugucuuguuccaucugccuguga

SEQ ID NO: 211157 - RNA, 1755 nt, Artificial Sequence; identical to SEQ ID NO: 211155
  derived and/or modified sequence opt5 from hemagglutinin__InfluenzaB__AHL94328

SEQ ID NO: 211158 - RNA, 1755 nt, Artificial Sequence; identical to SEQ ID NO: 211153
  derived and/or modified sequence opt5 from hemagglutinin__InfluenzaB__AHL94339

SEQ ID NO: 211159 - RNA, 1758 nt, Artificial Sequence
  derived and/or modified sequence opt5 from hemagglutinin__InfluenzaB__AHL94350
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaacccgcagaaguuuaccuccagcgcuaacggaguuacaacccacuacgugucucaaaucggcggcuucccuaaucagacggaggacgggggacugccccaguccggcagaaucguggucgauuauauggugcagaaaagcgggaagacaggaaccauuaccuaccaacggggcauccuccugccucagaaaguuuggugcgccucugggcgcuccaaggugauuaaaggaagccuuccccugaucggcgaagcugacugucuccaugagaaguauggcgggcugaacaaauccaagcccuacuacacaggagagcacgccaaggcgauuggcaauugcccuaucugggucaaaaccccgcugaagcucgccaacgggacaaaauauagacccccugcuaagcugcuuaaagaacggggauuuuucggcgccaucgcuggguuucuggagggcggaugggaaggcaugauugccggguggcauggauacacgucucacggcgcccacgggguggcuguugcggccgaucucaagagcacccaggaggcuaucaauaagauuacaaagaaccuuaauucccugagcgaacuggaggugaagaaccuccagcgccugucuggagccauggacgagcugcauaaugaaauccucgagcuggaugaaaaagucgacgaccuuagagccgauaccauuuccagccaaaucgagcuggcugugcuccugucuaacgaaggcaucauuaauagcgaggacgagcaccuucuggcccucgaacggaagcugaaaaagaugcuggggcccuccgcggucgagaucggcaacggauguuucgaaacaaagcauaaaugcaaucagaccugccucgaucgcauugcugccggcacguuugacgccggggaguucucucugccuaccuuugauagccuuaacaucacagcugccucccugaaugacgauggacucgacaaccacaccauucugcuguauuacagcacagcugccucuucccuugcggugacccucaugaucgccauuuucguuguguauauggucagcaaggauaacgugucuuguuccaucugccuguga

SEQ ID NO: 211160 - RNA, 1758 nt, Artificial Sequence
  derived and/or modified sequence opt5 from hemagglutinin__InfluenzaB__AHL94361
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaagcuguauggggauucuaacccgcagaaguuuaccuccagcgcuaacggaguuacaacccacuacgugucucaaaucggcggcuucccuaaucagacggaggacgggggacugccccaguccggcagaaucguggucgauuauauggugcagaaaagcgggaagacaggaaccauugccuaccaacggggcauccuccugccucagaaaguuuggugcgcuucugggcgcuccaaggugauuaaaggaagccuuccccugaucggcgaagccgacugucuccaugagaaguauggcgggcugaacaaauccaagcccuacuacaccggagagcacgcgaaggccauuggcaauugcccuaucugggucaaaacaccgcugaagcucgcuaacgggaccaaauauagacccccugccaagcugcuuaaagaacggggauuuuucggcgcuaucgccggguuucuggagggcggaugggaaggcaugauugccggguggcauggauacacaucucacggcgcucacgggguggcgguugccgcugaucucaagagcacgcaggaggccaucaauaagauuaccaaaaaccuuaauucccuuagcgaacuggaggugaagaaccuccagcgccugucuggagccauggacgagcugcauaaugaaauccucgagcuggaugaaaaagucgacgaccuuagagcugauacaauuuccagccaaaucgagcuggccgugcuccugucuaacgaaggcaucauuaauagcgaggacgagcaccuucuggcgcucgaacggaagcugaaaaagaugcuggggcccuccgcugucgagaucggcaacggauguuucgaaaccaagcauaaaugcaaucagacaugccucgaucgcauugccgccggcaccuuugacgcuggggaguucucucugccuacguuugauagccuuaacaucaccgccgcuucccugaaugacgauggacucgacaaccacacaauucugcuguauuacagcaccgccgcgucuucccuugccgugacacucaugaucgcuauuuucguuguguauauggucagcagagauucuguguccuguagcaucugccuguga

SEQ ID NO: 211161 - RNA, 1758 nt, Artificial Sequence
  derived and/or modified sequence opt5 from hemagglutinin__InfluenzaB__AHL94383
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggagaaacuuuauggggauucuaagccgcagaaguuuaccuccagcgccaacggaguuacaacccacuacgugucucaaaucggcggcuucccuaaccagacggaagacgggggacugccccaguccggcagaaucguggucgauuauauggugcaaaagagcgggaaaacaggaaccauuaccuaccagcggggcauccuccugccucagaagguuuggugcgcuucugggcgcuccaaagugauuaagggaagccuuccccugaucggcgaggccgacugucuccaugagaaauauggcgggcugaauaaguccaagcccuacuacacaggagaacacgcuaaagccauuggcaacugcccuaucugggucaagaccccgcugaaacucgcgaaugggacaaaguauagacccccugccaaacugcuuaaggagcggggauuuuucggcgcuaucgccggguuucuggaaggcggaugggagggcaugauugcuggguggcauggauacacgucucacggcgcccacgggguggccguugcugcggaucucaagagcacccaggaagccaucaacaaaauuacaaagaaucugaacucccuuagcgagcuggaggugaaaaaucuccagcgccugucuggagcuauggacgaacugcauaacgagauccucgaacuggaugagaaggucgacgaccuuagagccgauaccauuuccagccaaaucgaacuggccgugcuccugucuaaugagggcaucauuaacagcgaggacgaacaccuucuggcucucgagcggaaacugaagaagaugcuggggcccuccgccgucgaaaucggcaauggauguuucgagacaaaacauaagugcaaccagaccugccucgaucgcauugcggcuggcacguuugacgccggggaguucucucugccuaccuuugauagccuuaauaucacagccgcuucccugaacgacgauggacucgacaaucacaccauucugcuguauuacagcacagccgcuucuucccuugccgugacccucaugaucgcgauuuucguuguguauauggucagcagagauaacgugucuuguuccaucugccuguga

SEQ ID NO: 211162 - RNA, 1758 nt, Artificial Sequence; identical to SEQ ID NO: 209669
  derived and/or modified sequence opt5 from hemagglutinin__InfluenzaB__AHL94394

SEQ ID NO: 211163 - RNA, 1758 nt, Artificial Sequence
  derived and/or modified sequence opt5 from hemagglutinin__InfluenzaB__AHL94405
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuuaaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagcagagacaacgugucuuguuccaucugccuguga

SEQ ID NO: 211164 - RNA, 1758 nt, Artificial Sequence; identical to SEQ ID NO: 209669
  derived and/or modified sequence opt5 from hemagglutinin__InfluenzaB__AHL94416

SEQ ID NO: 211165 - RNA, 1755 nt, Artificial Sequence; identical to SEQ ID NO: 209878
  derived and/or modified sequence opt5 from hemagglutinin__InfluenzaB__AHL94427

SEQ ID NO: 211166 - RNA, 1755 nt, Artificial Sequence
  derived and/or modified sequence opt5 from hemagglutinin__InfluenzaB__AHL94438
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaauuggcuucuuugagaccauggcgugggccgugcccaaggacaauuauaaaaacgcuaccaauccucagacagucgaagugcccuacaucuguacggagggggaggaucagauuaccguguggggauuccauucugacaacaagacacaaaugaaaaaucuuuauggcgauuccaacccgcagaaguuuaccagcucugccaauggggucacaacccacuacguuucccagaucggagacuucccugaucagacggaagacggcggccugccccaaagcgggcggauugugguggauuauaugguccagaagccuggaaaaacaggcaccaucguguaccagcgcgggguucuccugccccagaagguguggugcgcuucuggaagauccaaagucaucaagggcagccuuccccugauuggggaggccgacugucuccaugaaaaauacggaggccugaacaaguccaaaccuuauuacaccggcgagcacgcgaaggccaucgggaacugcccgauuugggugaagacaccccugaaacucgcuaauggaaccaaguaucggccucccgccaaacugcuuaaggagcgcggcuuuuucggggcuaucgccggauuucuggaaggcgggugggagggcaugauugccggauggcacggcuacacaucucauggggcucacggaguugcgguggccgcugaccucaaaagcacgcaagaagccaucaacaagaucaccaagaaucugaacucccuuagcgagcuggaagucaaaaaucuccagagacugucuggcgccauggaugagcugcauaacgagauucucgaacuggacgagaagguggaugaccuucgggcugauacaaucuccagccagauugaacuggccguccuccugucuaaugaggggaucauuaacagcgaagacgagcaccuucuggcgcucgagcgcaaacugaagaaaaugcugggaccuuccgcuguggauaucggcaauggguguuucgaaaccaagcacaagugcaaccaaacaugccucgacagaaucgccgccggcaccuuuaaugcuggagaguucucucugcccacguuugauagccuuaacauuaccgccgcuucccugaaugacgauggccucgacaaccauacaauccugcuguauuacagcaccgccgcgucuucccuugccguuacacucaugcuggcuauuuucaucguguauauggucagccgggacaaugugucuuguuccauuugccuguga

SEQ ID NO: 211167 - RNA, 1755 nt, Artificial Sequence
  derived and/or modified sequence opt5 from hemagglutinin__InfluenzaB__AHL94460
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaauuggcuucuuugcgaccauggccugggcugugcccaaggacaauuauaaaaacgccaccaauccucagacagucgaggugcccuacaucuguacggaagaggaggaucagauuaccguguggggguuccauucugacaacaagacacaaaugaaaaaucuuuauggagauuccaacccgcagaaguuuaccagcucugcuaauggcgucacaacccacuacguuucccagaucggggacuucccugaucagacggaagacggaggccugccccaaagcggccggauugugguggauuauaugguccagaagccugggaaaacaggaaccaucguguaccagcgcggcguucuccugccccagaagguguggugcgccucugggagauccaaagucaucaagggaagccuuccccugauuggcgaggcggacugucuccaugaaaaauacgggggacugaacaaguccaaaccuuauuacaccggcgagcacgccaaggcuaucggcaacugcccgauuugggugaagacaccccugaaacucgccaaugggaccaaguaucggccucccgcuaaacugcuuaaggagcgcggauuuuucggcgccaucgccggguuucuggaaggaggcugggaggggaugauugcuggcuggcacggauacacaucucauggcgcgcacgggguugccguggcugccgaccucaaaagcacgcaagaagccaucaacaagaucaccaagaaucugaacucccuuagcgagcuggaagucaaaaaucuccagagacugucuggagcuauggaugagcugcauaacgagauucucgaacuggacgagaagguggaugaccuucgggccgauacaaucuccagccagauugaacuggcgguccuccugucuaaugagggcaucauuaacagcgaagacgagcaccuucuggcucucgagcgcaaacugaagaaaaugcuggggccuuccgccguggauaucggaaauggcuguuucgaaaccaagcacaagugcaaccaaacaugccucgacagaaucgccgcugggaccuuuaaugccggcgaguucucucugcccacguuugauagccuuaacauuaccgcugccucccugaaugacgauggacucgacaaccauacaauccugcuguauuacagcaccgcggccucuucccuugcuguuacacucaugcuggccauuuucaucguguauauggucagccgggacaaugugucuuguuccauuugccuguga

SEQ ID NO: 211168 - RNA, 1755 nt, Artificial Sequence
  derived and/or modified sequence opt5 from hemagglutinin__InfluenzaB__AHL94471
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucuuacaguggaggugcccuacaucuguacggaaggggaggaucagauuaccgucuggggauuccauucugacaauaaaacacagaugaagucccuguauggcgauagcaacccgcaaaaguuuaccucuuccgccaaugggguuacaacccacuacgugagccagaucggagacuucccugaucagacggaggacggcggccucccccagucugggcggauuguggucgauuauaugaugcaaaaaccuggaaagacaggcaccaucguguaccagcgcgggguucugcuuccccagaaaguguggugcgcuuccggaagaagcaaggucaucaaaggcucccugccccucauuggggaagccgacugucugcaugaggaauacggaggccugaacaagucuaaaccuuauuacaccggcaagcacgcgaaggccaucgggaauugcccgauuugggugaaaacaccccucaagcuggcuaacggaaccaaauaucggccucccgccaagcugcugaaagagcgcggcuuuuucggggcuaucgccggauuucucgagggcgggugggaaggcaugauugccggauggcacggcuacacaagccauggggcucacggaguugcgguggccgcugaccugaaguccacgcaggaggccaucaacaagaucaccaaaaaucuuaacagccugucugaacucgaggucaagaaucugcaaagacuguccggcgccauggaugaacuccauaacgagauucuggagcuugacgaaaaaguggaugaccugcgggcugauacaaucagcucucagauugagcucgccguccugcuuagcaaugaagggaucauuaacuccgaggacgaacaccuucucgcgcuggagcgcaagcugaaaaagaugcucggaccuucugcuguggauaucggcaauggguguuucgagaccaagcacaaaugcaaccagacaugccuggacagaaucgccgccggcaccuuuaaugcuggagaguucagccuucccacguuugauucccugaacauuaccgccgcuagccucaaugacgauggccuggacaaccauacaauccugcuuuauuacucuaccgccgcguccagccucgccguuacacugaugcuggcuauuuucaucguguauauggucucucgggacaauauuuccuguagcaucugccucuga

SEQ ID NO: 211169 - RNA, 1758 nt, Artificial Sequence
  derived and/or modified sequence opt5 from hemagglutinin__InfluenzaB__AHL94482
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuuacaaccauggccugggcugugcccaaaaacgacaagaauaaaaccgccacaaacccucugacgauugaagugcccuacaucuguaccgagggagaggaucagauuacagucuggggcuuccacagcgacaaugaaacccagauggcgaaacuuuauggggauucuaagccgcagaaguuuacauccagcgccaacggaguuaccacgcacuacgugucucaaaucggcggcuucccuaaccagacagaggacgggggacugccccaguccggcagaaucguggucgauuauauggugcaaaagagcgggaaaaccggaaccauuacauaccagcggggcauccuccugccucagaagguuuggugcgcuucugggcgcuccaaagugauuaagggaagccuuccccugaucggcgaagccgacugucuccaugagaaauauggcgggcugaauaaguccaagcccuacuacaccggagagcacgcuaaagccauuggcaacugcccuaucugggucaagacaccgcugaaacucgcgaaugggacgaaguauagacccccugccaaacugcuuaaggaacggggauuuuucggcgcuaucgccggguuucuggagggcggaugggaaggcaugauugcuggguggcauggauacaccucucacggcgcccacgggguggccguugcugcggaucucaagagcacacaggaggccaucaacaaaauuaccaagaaucugaacucccuuagcgaacuggaggugaaaaaucuccagcgccugucuggagcuauggacgagcugcauaacgaaauccucgagcuggaugaaaaggucgacgaccuuagagccgauacaauuuccagccaaaucgagcuggccgugcuccugucuaaugaaggcaucauuaacagcgaggacgagcaccuucuggcucucgaacggaaacugaagaagaugcuggggcccuccgccgucgagaucggcaauggauguuucgaaaccaaacauaagugcaaccagacgugccucgaucgcauugcggcuggcaccuuugacgccggggaguucucucugccuacauuugauagccuuaauaucaccgccgcuucccugaacgacgauggacucgacaaucacacaauucugcuguauuacagcaccgccgcuucuucccuugccgugacgcucaugaucgcgauuuucguuguguauauggucagcagagauaacgugucuuguuccaucugccuguga

SEQ ID NO: 211170 - RNA, 1755 nt, Artificial Sequence; identical to SEQ ID NO: 211153
  derived and/or modified sequence opt5 from hemagglutinin__InfluenzaB__AHL94493

SEQ ID NO: 211171 - RNA, 1755 nt, Artificial Sequence; identical to SEQ ID NO: 211155
  derived and/or modified sequence opt5 from hemagglutinin__InfluenzaB__AHL94504

SEQ ID NO: 211172 - RNA, 1758 nt, Artificial Sequence
  derived and/or modified sequence opt5 from hemagglutinin__InfluenzaB__AHL94515
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacguauaacgugauuaaugccgaggacgcuccgggcggccccuacaagaucgggacaagcggauccugcccuaacgucaccaauggcaacggguucuuugccacaauggcuugggccgugcccaaaaaugauaagaacaaaaccgcgaccaauccucugacaauugaagugcccuauaucuguacggagggagaggaccagauuaccgucuggggcuuccauagcgauaacgaaacacagauggagaagcuguacggggacucuaagccgcagaaauuuaccuccagcgccaauggaguuacaacccacuaugugucucaaaucggcggcuucccuaaccagacggaagaugggggacugccccaguccggcagaaucguggucgacuacauggugcaaaagagcgggaaaacaggaaccauuaccuaucagcggggcauccuccugccucagaagguuuggugcgcuucugggcgcuccaaagugauuaagggaagccuuccccugaucggcgaggccgauugucuccacgagaaauacggcgggcugaacaaguccaagcccuacuauacaggagaacaugcuaaagccauuggcaauugcccuaucugggucaagaccccgcugaaacucgcgaacgggacaaaguacagacccccugccaaacugcuuaaggagcggggauuuuucggcgcuaucgccggguuucuggaaggcggaugggagggcaugauugcuggguggcacggauauacgucucauggcgcccacgggguggccguugcugcggaccucaagagcacccaggaagccaucaauaaaauuacaaagaaccuuaauucccuuagcgagcuggaggugaaaaaccuccagcgccugucuggagcuauggaugaacugcacaaugagauccucgaacuggacgagaaggucgacgaucuuagagccgacaccauuuccagccaaaucgaacuggccgugcuccugucuaacgagggcaucauuaauagcgaggaugaacaucuucuggcucucgagcggaaacugaagaagaugcuggggcccuccgccgucgaaaucggcaacggauguuucgagacaaaacacaagugcaaucagaccugccucgaccgcauugcggcuggcacguuugaugccggggaguucucucugccuaccuuugacagccuuaacaucacagccgcuucccugaaugaugacggacucgauaaccauaccauucugcuguacuauagcacagccgcuucuucccuugccgugacccucaugaucgcgauuuucguuguguacauggucagcagagacaaugugucuuguuccaucugccuguga

SEQ ID NO: 211173 - RNA, 1755 nt, Artificial Sequence; identical to SEQ ID NO: 211155
  derived and/or modified sequence opt5 from hemagglutinin__InfluenzaB__AHL94526

SEQ ID NO: 211174 - RNA, 1758 nt, Artificial Sequence
  derived and/or modified sequence opt5 from hemagglutinin__InfluenzaB__AHL94537
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaacccgcagaaguuuaccuccagcgcuaacggaguuacaacccacuacaucucucaaaucggcggcuucccuaaucagacggaggacgggggacugccccaguccggcagaauugugguggauuauaugguccagaaaagcgggaagacaggaaccaucaccuaccaacggggcauucuccugccucagaaaguguggugcgccucugggcgcuccaagguuaucaaaggaagccuuccccugauuggcgaagcugacugucuccaugagaaguauggcgggcugaacaaauccaagcccuacuacacaggagagcacgccaaggcgaucggcaauugcccuaucugggugaaaaccccgcugaagcucgccaacgggacaaaauauagacccccugcuaagcugcuuaaagaacggggauuuuucggcgccauugcuggguuucuggagggcggaugggaaggcaugaucgccggguggcauggauacacgucucacggcgcccacggggucgcuguggcggccgaucucaagagcacccaggaggcuauuaauaagaucacaaagaaccuuaauucccugagcgaacuggagguuaagaaccuccagcgccugucuggagccauggacgagcugcauaaugaaauucucgagcuggaugaaaaaguggacgaccuuagagccgauaccaucuccagccaaaucgagcuggcuguccuccugucuaacgaaggcauuaucaauagcgaggacgagcaccuucuggcccucgaacggaagcugaaaaagaugcuggggcccuccgcgguggagauuggcaacggauguuucgaaacaaagcauaaaugcaaucagaccugccucgaucgcaucgcugccggcacguuugacgccggggaguucucucugccuaccuuugauagccuuaacauuacagcugccucccugaaugacgauggacucgacaaccacaccauccugcuguauuacagcacagcugccucuucccuugcggucacccucaugauugccaucuucgugguuuauauggugagcagagauaacgucucuuguuccaucugccuguga

SEQ ID NO: 211175 - RNA, 1755 nt, Artificial Sequence
  derived and/or modified sequence opt5 from hemagglutinin__InfluenzaB__AHL94548
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgauuaaguccuacuucgcgaaucuuaaaggcaccaagacgcgggggaaacugugucccgauugccucaacuguaccgaccuggauguggcucuuggacgcccuaugugcgucggcacaacccccucugccaaggccagcauccugcaugaagugagaccuguuacauccggguguuuucccaucaugcacgaccggaccaagauucgccaacucgcuaaucugcugagaggauaugagaacauccggcucucuacgcagaaugugauugaugccgaacgcgcuccuggcggcccguacagacuggggacaagcggauccugccccaacgccaccagcaaaucuggcuucuuugcgacaauggccugggcugucccuaaggacaauaacaaaaaugccaccaacccccuuaccguggaggugccuuauaucugugcugaaggggaggaucagauuacagucuggggauuccauuccgacaauaagacgcagaugaaaaaccuguacggcgauagcaauccccaaaaguuuaccucuuccgccaacgggguuacaacccacuaugugagccagaucggaggcuucccggaccagacagaggauggcgggcucccucagucuggacggauuguggucgacuacaugaugcaaaagcccggcaaaaccgggacgaucguguaucagcgcggaguucugcuuccucagaagguguggugcgcguccggcagaagcaaagucaucaaggggucccugccccucauuggagaagccgauugucugcaugagaaauacggcggccugaacaagucuaaacccuacuauacaggggaacacgcuaaggccaucggaaauugcccuauuugggugaagaccccgcucaaacuggcuaacggcaccaaguaccggcccccugccaaacuucugaaggagcgcggguuuuucggagccaucgcuggcuuucucgaagggggcugggaaggaaugauugcgggcuggcacggguauacaagccauggagcccacggcguugcuguggccgccgaccugaaauccacccaggaggcuaucaauaagaucacaaagaaccuuaauagccugucugaacucgaggucaaaaaccugcaaagacuguccggggccauggacgaacuccauaaugagauucuggagcuugaugaaaagguggacgaucugcgggcggacacgaucagcucucagauugagcucgcuguccugcuuagcaacgaaggaaucauuaauuccgaggaugaacaucugcucgcccuggagcgcaaacugaagaaaaugcucggccccucugccguggacaucgggaacggcuguuucgagaccaagcacaagugcaaucagacaugccuggauagaaucgcugccggaaccuuuaacgcuggcgaguucagccuuccuacauuugacucccugaauauuaccgccgcgagccucaacgaugacgggcuggauaaucacacgauccugcuuuacuauucuaccgccgcuuccagccucgccguuacacugaugcuggcuauuuucaucguguacauggucucucgggacaacguguccuguagcauuugccucuga

SEQ ID NO: 211176 - RNA, 1755 nt, Artificial Sequence; identical to SEQ ID NO: 211153
  derived and/or modified sequence opt5 from hemagglutinin__InfluenzaB__AHL94559

SEQ ID NO: 211177 - RNA, 1755 nt, Artificial Sequence; identical to SEQ ID NO: 209878
  derived and/or modified sequence opt5 from hemagglutinin__InfluenzaB__AHL94570

SEQ ID NO: 211178 - RNA, 1755 nt, Artificial Sequence; identical to SEQ ID NO: 209878
  derived and/or modified sequence opt5 from hemagglutinin__InfluenzaB__AHL94581

SEQ ID NO: 211179 - RNA, 1755 nt, Artificial Sequence; identical to SEQ ID NO: 209878
  derived and/or modified sequence opt5 from hemagglutinin__InfluenzaB__AHL94592

SEQ ID NO: 211180 - RNA, 1758 nt, Artificial Sequence
  derived and/or modified sequence opt5 from hemagglutinin__InfluenzaB__AHL94603
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaaaacauccgccucucuacgcacaaugugauuaacgccgagaaugcuccgggcggccccuauaagaucgggacaagcggauccugcccuaacgucaccaauggcaacggguucuuugccacaauggcuugggccgugcccaaaaaugacaagaacaaaaccgcgaccaauccucugacaauugaagugcccuacaucuguacggagggagaggaucagauuaccgucuggggcuuccauagcgacaacgaaacacagauggccaagcuguauggggauucuaagccgcagaaauuuaccuccagcgcuaacggaguuacaacccacuacgugucucaaaucggcggcuucccuaaucagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccacgagaaauauggcgggcugaacaaguccaagcccuacuacacaggagagcaugccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcacggauacacgucucauggcgcccacgggguggcuguugcggccgaucucaagagcacccaggaggcuaucaauaaaauuacaaagaaccuuaauucccuuagcgaacuggaggugaaaaaccuccagcgccugucuggagccauggacgagcugcacaaugaaauccucgagcuggaugaaaaggucgacgaccuuagagccgauaccauuuccagccaaaucgagcuggcugugcuccugucuaacgaaggcaucauuaauagcgaggacgagcaucuucuggcccucgaacggaaacugaagaagaugcuggggcccuccgcggucgagaucggcaacggauguuucgaaacaaaacacaagugcaaucagaccugccucgaucgcauugcugccggcacguuugacgccggggaguucucucugccuaccuuugauagccuuaacaucacagcugccucccugaaugacgauggacucgacaaccauaccauucugcuguauuacagcacagcugccucuucccuugcggugacccucaugaucgccauuuucguuguguauauggucagcagagauaacgugucuuguuccaucugccuguga

SEQ ID NO: 211181 - RNA, 1758 nt, Artificial Sequence
  derived and/or modified sequence opt5 from hemagglutinin__InfluenzaB__AHL94614
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacaucucucacggcgcccacgggguggcuguugcggccgaucucaagagcacgcaggaggcuauuaacaaaaucaccaagaaucugaacucccuuagcgaacuggaggugaaaaaucuccagcgccugucuggagccauggacgagcugcauaacgaaauucucgagcuggaugaaaaggucgacgaccuuagagccgauacaaucuccagccaaaucgagcuggcugugcuccugucuaaugaaggcauuaucaacagcgaggacgagcaccuucuggcccucgaacggaaacugaagaagaugcuggggcccuccgcggucgagauuggcaauggauguuucgaaaccaaacauaagugcaaccagacaugccucgaucgcaucgcugccggcaccuuugacgccggggaguucucucugccuacguuugauagccuuaauauuaccgcugccucccugaacgacgauggacucgacaaucacacaauccugcuguauuacagcaccgcugccucuucccuugcggugacacucaugauugccaucuucguuguguauauggucagcagagauaacgugucuuguuccaucugccuguga

SEQ ID NO: 211182 - RNA, 1755 nt, Artificial Sequence; identical to SEQ ID NO: 211155
  derived and/or modified sequence opt5 from hemagglutinin__InfluenzaB__AHL94624

SEQ ID NO: 211183 - RNA, 1758 nt, Artificial Sequence
  derived and/or modified sequence opt5 from hemagglutinin__InfluenzaB__AHL94646
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugccugaaugucaccaacggcaauggguucuuugccacaauggcuugggccgugccuaaaaacgacaagaauaaaaccgcgaccaacccccuuacaauugaagugccuuacaucuguacggagggagaggaucagauuaccgucuggggcuuccacagcgacaaugaaacacagauggccaagcuguauggggauucuaagccccagaaauuuaccuccagcgcuaacggaguuacaacccacuacgugucucaaaucggcggcuucccgaaccagacggaggacgggggacucccucaguccggcagaaucguggucgauuauauggugcaaaagagcgggaaaacaggaaccauuaccuaccagcggggcauccugcuuccccagaagguuuggugcgccucugggcgcuccaaagugauuaagggaagccugccucucaucggcgaagcugacugucugcaugagaaauauggcgggcugaauaaguccaagcccuacuacacaggagagcacgccaaagcgauuggcaacugccccaucugggucaagaccccucucaaacuggccaaugggacaaaguauagaccgcccgcuaaacuucugaaggaacggggauuuuucggcgccaucgcuggguuucucgagggcggaugggaaggcaugauugccggguggcauggauacacgucucacggcgcccacgggguggcuguugcggccgaucuuaagagcacccaggaggcuaucaacaaaauuacaaagaaucugaacucccugagcgaacucgaggugaaaaaucugcagcgccugucuggagccauggacgagcuccauaacgaaauccuggagcuugaugaaaaggucgacgaccugagagccgauaccauuuccagccaaaucgagcucgcugugcugcuuucuaaugaaggcaucauuaacagcgaggacgagcaucugcucgcccuggaacggaaacugaagaagaugcucgggccuuccgcggucgagaucggcaauggauguuucgaaacaaaacacaagugcaaccagaccugccuggaucgcauugcugccggcacguuugacgccggggaguucucucuucccaccuuugauagccugaauaucacagcugccucccucaacgacgauggacuggacaaucacaccauucugcuuuauuacagcacagcugccucuucccucgcggugacccugaugaucgccauuuucguuguguauauggucagcagagauaacgugucuuguuccaucugccuguga

SEQ ID NO: 211184 - RNA, 1758 nt, Artificial Sequence
  derived and/or modified sequence opt5 from hemagglutinin__InfluenzaB__AHL94657
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagagcgcucccggcggcccuuauaagaucgggacauccggaagcugccccaacgucaccaauggcaacggguucuuugccacaauggcuugggccgugccuaaaaaugacaagaacaaaaccgcgaccgauccccucacaauugaagugccguacaucuguacggagggagaggaccagauuaccgucuggggcuuccacucugauaaugaaacacagauggccaagcuguauggggacuccaagccucagaaauuuaccagcucugcuaacggaguuacaacccacuacgugucccaaaucggcggcuuccccaaucagacggaggaugggggacuuccucagagcggcagaaucguggucgacuauauggugcagaagucugggaaaacaggaaccauuaccuaccaacggggcauccugcucccccagaagguuuggugcgccuccgggcgcagcaaagugauuaagggaucccugccccuuaucggcgaagcugauugucugcaugagaaauauggcgggcucaacaagucuaagccuuacuacacaggagagcacgccaaagcgauuggcaacugcccgaucugggucaagacaccccugaaacuggccaaugggaccaaguauagaccucccgcuaaacuccugaaggaacggggauuuuucggcgccaucgcuggguuucuugagggcggaugggaaggcaugauugccggguggcauggauacacgagccacggcgcccacgggguggcuguugcggccgaccugaaguccacccaggaggcuaucaacaaaauuacaaagaaucucaacagccugucugaacuugaggugaaaaaucugcagcgccucuccggagccauggaugagcugcauaacgaaauccuggagcucgacgaaaaggucgacgaucugagagccgacaccauuagcucucaaaucgagcuugcugugcugcucagcaaugaaggcaucauuaacuccgaggaugagcaucugcuugcccuggaacggaaacucaagaagaugcuggggccuucugcggucgagaucggcaauggauguuucgaaacaaaacacaagugcaaccagaccugccuggaccgcauugcugccggcacguuugaugccggggaguucagccuccccaccuuugacucccugaauaucacagcugccagccuuaacgaugacggacuggauaaucacaccauucuccuguauuacucuacagcugccuccagccuggcggugacccuuaugaucgccauuuucguuguguauauggucucuagagacaacguguccuguagcaucugccucuga

SEQ ID NO: 211185 - RNA, 1755 nt, Artificial Sequence; identical to SEQ ID NO: 211155
  derived and/or modified sequence opt5 from hemagglutinin__InfluenzaB__AHL94668

SEQ ID NO: 211186 - RNA, 1755 nt, Artificial Sequence; identical to SEQ ID NO: 211155
  derived and/or modified sequence opt5 from hemagglutinin__InfluenzaB__AHL94679

SEQ ID NO: 211187 - RNA, 1758 nt, Artificial Sequence; identical to SEQ ID NO: 211180
  derived and/or modified sequence opt5 from hemagglutinin__InfluenzaB__AHL94690

SEQ ID NO: 211188 - RNA, 1758 nt, Artificial Sequence
  derived and/or modified sequence opt5 from hemagglutinin__InfluenzaB__AHL94701
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacacuuaccaagucccauuucgcgaaucugaaaggcacggaaacccgggggaagcucuguccgaaaugccugaacuguacagaucuugacguggcucugggacgccccaagugcaccggcaagauuccuucugccagagucagcauccuccacgaggugcggcccguuacauccggguguuuuccuaucaugcaugaucgcaccaaaauuagacaacugcccaaucugcuccggggauacgaacacauccgccugucuacgcauaacgugauuaaugccgagaacgcuccuggcggcccguauaagaucgggacaagcggauccugccuuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaagcucuauggggauucuaagccucagaaauuuaccuccagcgcuaacggaguuacaacccacuacgugucucaaaucggcggcuuccccaaccagacggaggacgggggacugccgcaguccggcagaaucguggucgauuauauggugcaaaagagcgggaaaacaggaaccauuaccuaccagcggggcauccuucugccucagaagguuuggugcgccucugggcgcuccaaagugauuaagggaagccucccccugaucggcgaagcugacugucugcaugagaaauauggcgggcucaauaaguccaagccuuacuacacaggagagcacgccaaagcgauuggcaacugccccaucugggucaagacaccccugaaacuugccaaugggaccaaguauagaccuccggcuaaacugcucaaggaacggggauuuuucggcgccaucgcuggguuucuggagggcggaugggaaggcaugauugccggguggcauggauacacgucucacggcgcccacgggguggcuguugcggccgaucuuaagagcacccaggaggcuaucaacaaaauuacaaagaaucugaacucccucagcgaacuggaggugaaaaaucugcagcgccucucuggagccauggacgagcugcauaacgaaauccuugagcuggaugaaaaggucgacgaccucagagccgauaccauuuccagccaaaucgagcuggcugugcuucugucuaaugaaggcaucauuaacagcgaggacgagcaccuccuggcccuggaacggaaacucaagaagaugcuggggcccuccgcggucgagaucggcaauggauguuucgaaacaaaacauaagugcaaccagaccugccuugaucgcauugcugccggcacguuugacgccggggaguucucucugccuaccuuugauagccucaauaucacagcugccucccugaacgacgauggacuggacaaucacaccauucuucucuauuacagcacagcugccucuucccuggcggugacccugaugaucgccauuuucguuguguauauggucagcagagauaacgugucuuguuccaucugccucuga

SEQ ID NO: 211189 - RNA, 1755 nt, Artificial Sequence; identical to SEQ ID NO: 211153
  derived and/or modified sequence opt5 from hemagglutinin__InfluenzaB__AHL94712

SEQ ID NO: 211190 - RNA, 1758 nt, Artificial Sequence; identical to SEQ ID NO: 211184
  derived and/or modified sequence opt5 from hemagglutinin__InfluenzaB__AHL94723

SEQ ID NO: 211191 - RNA, 1755 nt, Artificial Sequence; identical to SEQ ID NO: 211153
  derived and/or modified sequence opt5 from hemagglutinin__InfluenzaB__AHL94734

SEQ ID NO: 211192 - RNA, 1758 nt, Artificial Sequence
  derived and/or modified sequence opt5 from hemagglutinin__InfluenzaB__AHL94745
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugccugaaugucaccaacggcaauggguucuuugccacaauggcuugggccgugccuaaaaacgacaagaauaaaaccgcgaccaacccccuuacaauugaagugccuuacaucuguacggagggagaggaucagauuaccgucuggggcuuccacagcgacaaugaaacacagauggccaagcuguauggggauucuaagccccagaaauuuaccuccagcgcuaacggaguuacaacccacuacgugucucaaaucggcggcuucccgaaccagacggaggacgggggacucccucaguccggcagaaucguggucgauuauauggugcaaaagagcgggaaaacaggaaccauuaccuaccagcggggcauccugcuuccccagaagguuuggugcgccucugggcgcuccaaagugauuaagggaagccugccucucaucggcgaagcugacugucugcaugagaaauauggcgggcugaauaaguccaagcccuacuacacaggagagcacgccaaagcgauuggcaacugccccaucugggucaagaccccucucaaacuggccaaugggacaaaguauagaccgcccgcuaaacuucugaaggaacggggauuuuucggcgccaucgcuggguuucucgagggcggaugggaaggcaugauugccggguggcauggauacacgucucacggcgcccacgggguggcuguugcggccgaucuuaagagcacccaggaggcuaucaacaaaauuacaaagaaucugaacucccugagcgaacucgaggugaaaaaucugcagcgccugucuggagccauggacgagcuccauaacgaaauccuggagcuugaugaaaaggucgacgaccugagagccgauaccauuuccagccaaaucgagcucgcugugcugcuuucuaaugaaggcaucauuaacagcgaggacgagcaucugcucgcccuggaacggaaacugaagaagaugcucgggccuuccgcggucgagaucggcaauggauguuucgaaacaaaacacaagugcaaccagaccugccuggaucgcauugcugccggcacguuugacgccggggaguucucucuucccaccuuugauagccugaauaucacagcugccucccucaacggagacggccuggauaaucacaccauucugcuuuauuacagcacagcugccucuucccucgcggugacccugaugaucgccauuuucguuguguauauggucagcagagacaacgugucuuguuccaucugccuguga

SEQ ID NO: 211193 - RNA, 1755 nt, Artificial Sequence; identical to SEQ ID NO: 209878
  derived and/or modified sequence opt5 from hemagglutinin__InfluenzaB__AHL94756

SEQ ID NO: 211194 - RNA, 1758 nt, Artificial Sequence; identical to SEQ ID NO: 211183
  derived and/or modified sequence opt5 from hemagglutinin__InfluenzaB__AHL94766

SEQ ID NO: 211195 - RNA, 1755 nt, Artificial Sequence
  derived and/or modified sequence opt5 from hemagglutinin__InfluenzaB__AHL94777
augaaggccaucauugugcugcucauggucguuaccagcaacgcugacagaaucugcacaggcauuacguccucuaauagcccccacguggugaaaaccgccacacagggggaggucaacgugaccggagcgaucccucugacaaccacaccgaccaaguccuacuucgcuaaucuuaaaggcacgcggacccgcgggaagcugugucccgauugcuuuaacuguacagaccucgauguugcccugggaagaccuaugugcgugggcaccacacccucugccaaagcuagcauucuucaugaaguccggccugugaccuccggguguuuccccaucaugcacgaccgcacgaagaucagacaacugccuaaucuccugcggggauaugagaacauucgccugucuacacagaaugccaucgaugcugaaaaggccccgggcggccccuacagacucgggaccagcggauccugcccuaacgcgacaagcaaaauuggcuuuuucgccaccauggcuugggccguucccaaggacaauuauaaaaacgcuaccaauccucagacaguggagguccccuacaucuguacggaaggggaggaucagauuaccguguggggauuucauucugacaacaagacacaaaugaaaaaucuguauggcgauuccaacccgcagaaguucaccagcucugccaauggggugacaacccacuacgucucccagaucggagacuuuccugaucagacggaggacggcggccuuccccaaagcgggcggauuguuguggauuauauggugcagaagccuggaaaaacaggcaccaucgucuaccagcgcggggugcugcucccccagaagguuuggugcgcgucuggaagauccaaagugaucaagggcagccugccccuuauuggggaagccgacugucugcaugagaaauacggaggccucaacaaguccaaaccuuauuacaccggcgaacacgcuaaggccaucgggaacugcccgauuugggucaagacaccccugaaacuggcuaauggaaccaaguaucggccucccgccaaacuccugaaggagcgcggcuucuuuggggccaucgcuggauuccuugagggcgggugggaaggcaugauugcgggauggcacggcuacacaucucauggggcccacggaguggcuguugccgccgaccugaaaagcacgcaagaggcuaucaacaagaucaccaagaaucucaacucccugagcgaacuugaggugaaaaaucugcagagacucucuggcgccauggaugaacugcauaacgagauucuggagcucgacgaaaaggucgaugaccugcgggcggauacaaucuccagccagauugagcuugcugugcugcucucuaaugaagggaucauuaacagcgaggacgaacaucugcuugcccuggagcgcaaacucaagaaaaugcugggaccuuccgccgucgauaucggcaauggguguuuugagaccaagcacaagugcaaccaaacaugccuggacagaaucgcugccggcaccuucaaugcuggagaauuuucucuccccacguucgauagccugaacauuaccgccgcgucccuuaaugacgauggccuggacaaccacacaauccuccuguauuacagcaccgccgcuucuucccuggccgugacacuuaugcucgcuauuuucaucguuuauauggugagccgggacaaugucucuuguuccauuugccuguga

SEQ ID NO: 211196 - RNA, 1758 nt, Artificial Sequence; identical to SEQ ID NO: 211180
  derived and/or modified sequence opt5 from hemagglutinin__InfluenzaB__AHL94797

SEQ ID NO: 211197 - RNA, 1755 nt, Artificial Sequence
  derived and/or modified sequence opt5 from hemagglutinin__InfluenzaB__AHL94808
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaaguccuacuucgcuaaucuuaaaggcauucggacgcgcgggaagcugugucccgauugccucaacuguaccgaccuggauguugcccuuggaagaccuaugugcgugggcacaacccccucugccaaagcuagcauccugcaugaaguccggccugugacauccggguguuuucccaucaugcacgaccgcaccaagauuagacaacucccuaaucugcugcggggauaugagaacauccgccucucuacgcagaauguuauugaugccgaaaaggcuccgggcggccccuacagacuggggacaagcggauccugcccuaacgccaccagcaaaaucggcuucuuugcgacaauggccugggcugugcccaaggacaauuauaaaaacgccaccaauccucagaccgucgaggugcccuacauuuguacagaaggggaggaucagaucacgguguggggauuccauucugacaacaagacccaaaugaaaaaucuuuauggcgauuccaacccgcagaaguuuacaagcucugcuaauggggucaccacacacuacguuucccagauuggagacuucccugaucagaccgaggacggcggccugccccaaagcgggcggaucgugguggauuauaugguccagaagccuggaaaaacgggcacaaucguguaccagcgcgggguucuccugccccagaagguguggugcgccucuggaagauccaaagucauuaagggcagccuuccccugaucggggaagcggacugucuccaugagaaauacggaggccugaacaaguccaaaccuuauuacaccggcgaacacgccaaggcuauugggaacugcccgaucugggugaagacaccccugaaacucgccaauggaaccaaguaucggccucccgcuaaacugcuuaaggagcgcggcuuuuucggggccauugccggauuucuggagggcgggugggaaggcaugaucgcuggauggcacggcuacaccucucauggggcgcacggaguugccguggcugccgaccucaaaagcacacaagaggccaucaacaagauuacgaagaaucugaacucccuuagcgaacuggaggucaaaaaucuccagagacugucuggcgcuauggaugaacugcauaacgagauccucgagcuggacgaaaagguggaugaccuucgggccgauaccauuuccagccagaucgagcuggcgguccuccugucuaaugaagggauuaucaacagcgaggacgaacaccuucuggcucucgagcgcaaacugaagaaaaugcugggaccuuccgccguggauaucggcaauggguguuucgagacaaagcacaagugcaaccaaaccugccucgacagaauugccgcuggcacauuuaaugccggagaguucucucugcccaccuuugauagccuuaacaucacggcugccucccugaaugacgauggccucgacaaccauaccauucugcuguauuacagcacagcggccucuucccuugcuguuacccucaugcuggccaucuucauuguguauauggucagccgggacaaugugucuuguuccaucugccuguga

SEQ ID NO: 211198 - RNA, 1755 nt, Artificial Sequence
  derived and/or modified sequence opt5 from hemagglutinin__InfluenzaB__AHL94817
augaaggccaucauugugcugcucauggucguuaccagcaacgcugacagaaucugcacaggcauuacguccucuaauagcccccacguggugaaaaccgccacacagggggaagucaacgugaccggagcgaucccucugacaaccacaccgaccaaguccuacuucgcuaaucuuaaaggcacgcggacccgcgggaagcugugucccgauugccucaacuguacagaccuggauguugcccuuggaagaccuaugugcgugggcaccacacccucugccaaagcuagcauucugcaugaaguccggccugugaccuccggguguuuucccaucaugcacgaccgcacgaagaucagacaacucccuaaucugcugcggggauaugagaacauucgccucucuacacagaauguuaucgaugccgaaaaggcuccgggcggccccuacagacuggggaccagcggauccugcccuaacgccacaagcaaaauuggcuucuuugcgaccauggccugggcugugcccaaggacaauuauaaaaacgccaccaauccucagacagucgaggugcccuacaucuguacggaaggggaggaucagauuaccguguggggauuccauucugacaacaagacacaaaugaaaaaucuuuauggcgauuccaacccgcagaaguuuaccagcucugcuaauggggucacaacccacuacguuucccagaucggagacuucccugaucagacggaggacggcggccugccccaaagcgggcggauugugguggauuauaugguccagaagccuggaaaaacaggcaccaucguguaccagcgcgggguucuccugccccagaagguguggugcgccucuggaagauccaaagucaucaagggcagccuuccccugauuggggaagcggacugucuccaugagaaauacggaggccugaacaaguccaaaccuuauuacaccggcgaacacgccaaggcuaucgggaacugcccgauuugggugaagacaccccugaaacucgccaauggaaccaaguaucggccucccgcuaaacugcuuaaggagcgcggcuuuuucggggccaucgccggauuucuggagggcgggugggaaggcaugauugcuggauggcacggcuacacaucucauggggcgcacggaguugccguggcugccgaccucaaaagcacgcaagaggccaucaacaagaucaccaagaaucugaacucccuuagcgaacuggaggucaaaaaucuccagagacugucuggcgcuauggaugaacugcauaacgagauuaucgagcucgacgaaaagguggaugaccugcgggccgauacaauuuccagccagaucgagcuugcgguccugcucucuaaugaagggauuaucaacagcgaggacgaacaucugcuugcucuggagcgcaaacucaagaaaaugcugggaccuuccgccguggauaucggcaauggguguuucgagaccaagcacaagugcaaccaaacaugccuggacagaauugccgcuggcaccuuuaaugccggagaguucucucuccccacguuugauagccugaacaucaccgcugccucccuuaaugacgauggccuggacaaccacacaauucuccuguauuacagcaccgcggccucuucccuggcuguuacacuuaugcucgccaucuucauuguguauauggucagccgggacaaugugucuuguuccaucugccuguga

SEQ ID NO: 211199 - RNA, 1758 nt, Artificial Sequence; identical to SEQ ID NO: 210889
  derived and/or modified sequence opt5 from hemagglutinin__InfluenzaB__AHL94827

SEQ ID NO: 211200 - RNA, 1755 nt, Artificial Sequence
  derived and/or modified sequence opt5 from hemagglutinin__InfluenzaB__AHL94837
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccggcgaaguccuacuucgcuaaucuuaaaggcacccggacgcgcgggaagcugugucccgauugccucaacuguaccgaccuggauguggcccuuggaagaccuaugugcgucggcacaacccccucugccaaagcuagcauucugcaugaagugcggccuguuacauccggguguuuucccaucaugcacgaccgcaccaagaucagacaacucccuaaucugcugcggggauaugagaacauucgccucucuacgcagaaugugaucgaugccgaaaaggcuccgggcggccccuacaaacuggggacaagcggauccugcccuaacgccaccagcaagauuggcuucuuugcgacaauggccugggcuguccccaaagacaauuauaagaacgccaccaauccucuuaccguggaggugcccuacaucuguaaagaaggggaggaucagauuacagucuggggauuccauucugacaacaagacgcagaugaagaaucuguauggcgauuccaacccgcaaaaauuuaccagcucugcuaaugggguuacaacccacuacgugucccagaucggagacuucccugaucagacagaggacggcggccucccccagagcgggagaauuguggucgauuauaugaugcaaaagccuggaaaaaccggcacgaucguguaccagcgcgggguucugcuuccccagaagguguggugcgccucuggacgguccaaagucaucaagggcagccugccccucauuggggaagcggacugucugcaugaggaauacggaggccugaacaaauccaagccuuauuacacaggcaagcacgccaaagcuaucgggaacugcccgauuugggugaagacaccccucaaacuggccaauggaaccaaguauagaccucccgcuaaacuucugaaggagcggggcuuuuucggggccaucgccggauuucucgagggcgggugggaaggcaugauugcuggauggcacggcuacaccucucauggggcgcacggaguugccguggcugccgaccuuaagagcacccaggaggccaucaacaaaaucacaaagaaucugaacucccugagcgaacucgaggucaaaaaucugcaacgccugucuggcgcuauggaugaacuccauaacgagauucuggagcuugacgaaaagguggaugaccugagagccgauacgaucuccagccagauugagcucgcgguccugcuuucuaaugaagggaucauuaacagcgaggacgaacaucugcucgcucuggagcggaaacugaagaagaugcucggaccuuccgccguggauaucggcaauggguguuucgagaccaaacacaagugcaaccagacaugccuggaccgcaucgccgcuggcaccuuuaaugccggagaguucucucuucccacauuugauagccugaacauuaccgcugccucccucaaugacgauggccuggacaaccacacgauccugcuuuauuacagcaccgcggccucuucccucgcuguuacacugaugcuggccauuuucaucguguauauggucagcagagacaaugugucuuguuccauuugccucuga

SEQ ID NO: 211201 - RNA, 1755 nt, Artificial Sequence; identical to SEQ ID NO: 209878
  derived and/or modified sequence opt5 from hemagglutinin__InfluenzaB__AHL94847

SEQ ID NO: 211202 - RNA, 1758 nt, Artificial Sequence
  derived and/or modified sequence opt5 from hemagglutinin__InfluenzaB__AHL94858
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaauauucccucugccagagucagcauccugcacgaggugcggccuguuacauccggguguuuucccaucaugcaugaucgcaccaagauuagacaacucccuaaccugcugcggggauacgaacacauccgccucucuacgcauaaugugauuaacgccgagaaugcuccgggcggccccuauaaaaucgggacaagcggauccugcccuaacgucaccaauggcaacggguucuuugccacaauggcuugggccgugcccaagaaugacaacaauaaaaccgcgaccaacagccugacaauugaagugccuuacaucuguacggagggagaggaucagauuaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaaucguggucgauuauauggugcagaagucugggaaagccggaacaauuaccuaccaacggggcauccuccugccccagaagguuuggugcgcuuccgggcgcagcaaagugauuaagggaucccuuccucugaucggcgaagccgacugucuccaugagaaauauggcgggcugaauaagucuaaacccuacuacaccggagagcacgcgaaggccauuggcaacugccccaucugggucaagacaccucugaaacucgcuaaugggaccaaguauagaccgcccgccaaacugcuuaaggaacggggauuuuucggcgcuaucgccggguuucuggagggcggaugggaaggcaugauugccggguggcauggauacacaagccacggcgcucacgggguggcgguugccgcugaucucaaauccacgcaggaggccaucaacaagauuaccaagaaucugaacagccuuucugaacuggaggugaaaaaucuccagcgccuguccggagccauggacgagcugcauaacgaaauccucgagcuggaugaaaaggucgacgaccuuagagcugauacaauuagcucucaaaucgagcuggccgugcuccugagcaaugaaggcaucauuaacuccgaggacgagcaccuucuggcgcucgaacggaaacugaagaaaaugcuggggccuucugcugucgagaucggcaauggauguuucgaaaccaagcauaagugcaaccagacaugccucgaucgcauugccgccggcaccuuugacgcuggggaguucagccugcccacguuugauucccuuaauaucaccgccgcuagccugaacgacgauggacucgacaaccacacaauucugcuguauuacucuaccgccgcguccagccuugccgugacacucaugaucgcuauuuucguuguguauauggucucuagagauaauguguccuguagcaucugccuguga

SEQ ID NO: 211203 - RNA, 1755 nt, Artificial Sequence; identical to SEQ ID NO: 209844
  derived and/or modified sequence opt5 from hemagglutinin__InfluenzaB__AHL94869

SEQ ID NO: 211204 - RNA, 1758 nt, Artificial Sequence; identical to SEQ ID NO: 210013
  derived and/or modified sequence opt5 from hemagglutinin__InfluenzaB__AHL94880

SEQ ID NO: 211205 - RNA, 1758 nt, Artificial Sequence; identical to SEQ ID NO: 210346
  derived and/or modified sequence opt5 from hemagglutinin__InfluenzaB__AHL94889

SEQ ID NO: 211206 - RNA, 1758 nt, Artificial Sequence; identical to SEQ ID NO: 210013
  derived and/or modified sequence opt5 from hemagglutinin__InfluenzaB__AHL94900

SEQ ID NO: 211207 - RNA, 1758 nt, Artificial Sequence
  derived and/or modified sequence opt5 from hemagglutinin__InfluenzaB__AHL94911
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggcggacaggaaccauuaccuaccagcgcggcauccugcucccccagaaaguuuggugcgccucugggagauccaaggugauuaaaggaagccugccccuuaucggcgaagcugacugucugcaugagaaguauggcgggcucaauaaauccaagccuuacuacacaggagagcacgccaaggcgauuggcaacugcccgaucugggucaaaacaccccugaagcuggccaaugggacaaaauaucggccucccgcuaagcuccugaaagaacgcggauuuuucggcgccaucgcuggguuucuugagggcggaugggaaggcaugauugccggguggcauggauacacgucucacggcgcccacgggguggcuguugcggccgaucucaagagcacccaggaggcuaucaacaagauuaccaaaaaucugaacucccugagcgaacuugaggugaagaaucugcagagacucucuggagccauggacgagcugcauaacgaaauccuggagcucgaugaaaaagucgacgaccugcgggccgauaccauuuccagccaaaucgagcuugcugugcugcucucuaaugaaggcaucauuaacagcgaggacgagcaucugcuugcccuggaacgcaagcucaaaaagaugcuggggccuuccgcggucgagaucggcaauggauguuucgaaacaaagcacaaaugcaaccagaccugccuggauagaauugcugccggcacguuugacgccggggaguucucucuccccaccuuugauagccugaauaucacagcugccucccuuaacgacgauggacuggacaaucacaccauucuccuguauuacagcacagcugccucuucccuggcggugacccuuaugaucgccauuuucguuguguauauggucagccgggauaacgugucuuguuccaucugccucuga

SEQ ID NO: 211208 - RNA, 1758 nt, Artificial Sequence; identical to SEQ ID NO: 210013
  derived and/or modified sequence opt5 from hemagglutinin__InfluenzaB__AHL94922

SEQ ID NO: 211209 - RNA, 1758 nt, Artificial Sequence
  derived and/or modified sequence opt5 from hemagglutinin__InfluenzaB__AHL94933
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaagccggaacaaucaccuaccagcggggcauucuccugccucagaagguguggugcgcuucugggcgcuccaaaguuaucaagggaagccuuccccugauuggcgaagccgacugucuccaugagaaauauggcgggcugaauaaguccaagcccuacuacaccggagagcacgcgaaagccaucggcaacugcccuaucugggugaagacaccgcugaaacucgcuaaugggaccaaguauagacccccugccaaacugcuuaaggaacggggauuuuucggcgcuauugccggguuucuggagggcggaugggaaggcaugaucgccggguggcauggauacacaucucacggcgcucacggggucgcgguggccgcugaucucaagagcacgcaggaggccauuaacaaaaucaccaagaaucugaacucccuuagcgaacuggagguuaaaaaucuccagcgccugucuggagccauggacgagcugcauaacgaaauucucgagcuggaugaaaagguggacgaccuuagagcugauacaaucuccagccaaaucgagcuggccguccuccugucuaaugaaggcauuaucaacagcgaggacgagcaccuucuggcgcucgaacggaaacugaagaagaugcuggggcccuccgcuguggagauuggcaauggauguuucgaaaccaaacauaagugcaaccagacaugccucgaucgcaucgccgccggcaccuuugacgcuggggaguucucucugccuacguuugauagccuuaauauuaccgccgcuucccugaacgacgauggacucgacaaucacacaauccugcuguauuacagcaccgccgcgucuucccuugccgucacacucaugauugcuaucuucgugguuuauauggugagcagagauaacgucucuuguuccaucugccuguga

SEQ ID NO: 211210 - RNA, 1758 nt, Artificial Sequence; identical to SEQ ID NO: 211094
  derived and/or modified sequence opt5 from hemagglutinin__InfluenzaB__AHL94944

SEQ ID NO: 211211 - RNA, 1758 nt, Artificial Sequence; identical to SEQ ID NO: 209707
  derived and/or modified sequence opt5 from hemagglutinin__InfluenzaB__AHL94955

SEQ ID NO: 211212 - RNA, 1758 nt, Artificial Sequence; identical to SEQ ID NO: 209707
  derived and/or modified sequence opt5 from hemagglutinin__InfluenzaB__AHL94965

SEQ ID NO: 211213 - RNA, 1758 nt, Artificial Sequence; identical to SEQ ID NO: 209707
  derived and/or modified sequence opt5 from hemagglutinin__InfluenzaB__AHL94975

SEQ ID NO: 211214 - RNA, 1755 nt, Artificial Sequence; identical to SEQ ID NO: 209878
  derived and/or modified sequence opt5 from hemagglutinin__InfluenzaB__AHM00986

SEQ ID NO: 211215 - RNA, 1758 nt, Artificial Sequence; identical to SEQ ID NO: 209911
  derived and/or modified sequence opt5 from hemagglutinin__InfluenzaB__AHM00997

SEQ ID NO: 211216 - RNA, 1758 nt, Artificial Sequence
  derived and/or modified sequence opt5 from hemagglutinin__InfluenzaB__AHM01008
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuuggaccgugcccaaaaaugauaagaacaaaaccgccacaaauccucugacgauugaagugcccuacaucuguaccgagggagaggaccagauuacagucuggggcuuccacagcgauaacgaaacccagauggcgaagcuguauggggacucuaagccgcagaaauuuacauccagcgccaauggaguuaccacgcacuacgugucucaaaucggcggcuucccuaaccagacagaggaugggggacugccccaguccggcagaaucguggucgacuauauggugcaaaagagcgggaaaaccggaaccauuacauaccagcggggcauccuccugccucagaagguuuggugcgcuucugggcgcuccaaagugauuaagggaagccuuccccugaucggcgaagccgauugucuccaugagaaauauggcgggcugaacaaguccaagcccuacuacaccggagagcacgcuaaagccauuggcaauugcccuaucugggucaagacaccgcugaaacucgcgaacgggacgaaguauagacccccugccaaacugcuuaaggaacggggauuuuucggcgcuaucgccggguuucuggagggcggaugggaaggcaugauugcuggguggcauggauacaccucucacggcgcccacgggguggccguugcugcggaccucaagagcacacaggaggccaucaauaaaauuaccaagaaccuuaauucccuuagcgaacuggaggugaaaaaccuccagcgccugucuggagcuauggaugagcugcauaaugaaauccucgagcuggacgaaaaggucgacgaucuuagagccgacacaauuuccagccaaaucgagcuggccgugcuccugucuaacgaaggcaucauuaauagcgaggaugagcaccuucuggcucucgaacggaaacugaagaagaugcuggggcccuccgccgucgagaucggcaacggauguuucgaaaccaaacauaagugcaaucagacgugccucgaccgcauugcggcuggcaccuuugaugccggggaguucucucugccuacauuugacagccuuaacaucaccgccgcuucccugaaugaugacggacucgauaaccacacaauucugcuguauuacagcaccgccgcuucuucccuugccgugacgcucaugaucgcgauuuucguuguguauauggucagcagagacaaugugucuuguuccaucugccuguga

SEQ ID NO: 211217 - RNA, 1758 nt, Artificial Sequence; identical to SEQ ID NO: 209911
  derived and/or modified sequence opt5 from hemagglutinin__InfluenzaB__AHM01019

SEQ ID NO: 211218 - RNA, 1758 nt, Artificial Sequence; identical to SEQ ID NO: 209911
  derived and/or modified sequence opt5 from hemagglutinin__InfluenzaB__AHM01030

SEQ ID NO: 211219 - RNA, 1758 nt, Artificial Sequence
  derived and/or modified sequence opt5 from hemagglutinin__InfluenzaB__AHM01041
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcagaaaagcgaaaagacagggaccauuaccuaccaacggggaauccuccugccucagaagguuuggugcgccucuggccgcuccaaagugauuaaggggagccuuccccugaucggagaggcugauugucuccaugagaaauauggcggccugaacaaguccaagcccuacuacacaggggaacacgccaaagcgauuggaaauugcccuaucugggucaagaccccgcugaaacucgccaacggcacaaaguauagacccccugcuaaacugcuuaaggagcggggguuuuucggagccaucgcuggcuuucuggaagggggcugggagggaaugauugccggcuggcauggguacacgucucacggagcccacggcguggcuguugcggccgaccucaagagcacccaggaagcuaucaauaaaauuacaaagaaccuuaauucccuuagcgagcuggaggugaaaaaccuccagcgccugucuggggccauggaugaacugcauaaugagauccucgaacuggacgagaaggucgacgaucuuagagccgacaccauuuccagccaaaucgaacuggcugugcuccugucuaacgagggaaucauuaauagcgaggaugaacaccuucuggcccucgagcggaaacugaagaagaugcugggccccuccgcggucgaaaucgggaacggcuguuucgagacaaaacauaagugcaaucagaccugccucgaccgcauugcugccggaacguuugaugccggcgaguucucucugccuaccuuugacagccuuaacaucacagcugccucccugaaugaugacgggcucgauaaccacaccauucugcuguauuacagcacagcugccucuucccuugcggugacccucaugaucgccauuuucguuguguauauggucagcagagacaaugugucuuguuccaucugccuguga

SEQ ID NO: 211220 - RNA, 1758 nt, Artificial Sequence
  derived and/or modified sequence opt5 from hemagglutinin__InfluenzaB__AHM01052
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauuaugcuguauuacagcacagcugccucuucccuggcggugacccuuaugaucgccauuuucguuguguauauggucagcagagauaacgugucuuguuccaucugccucuga

SEQ ID NO: 211221 - RNA, 1758 nt, Artificial Sequence; identical to SEQ ID NO: 209911
  derived and/or modified sequence opt5 from hemagglutinin__InfluenzaB__AHM01063

SEQ ID NO: 211222 - RNA, 1755 nt, Artificial Sequence; identical to SEQ ID NO: 209878
  derived and/or modified sequence opt5 from hemagglutinin__InfluenzaB__AHM01074

SEQ ID NO: 211223 - RNA, 1755 nt, Artificial Sequence
  derived and/or modified sequence opt5 from hemagglutinin__InfluenzaB__AHM01096
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaauccugcuuccucagaaaguuuggugcgcguccggccgcagcaaggugaucaaagggucccugccccucauuggagaagccgauugucugcaugagaaguacggcggccugaacaaaucuaagcccuacuauaccggggaacacgcuaaggccaucggaaauugcccuauuugggucaaaaccccgcucaagcuggcuaacggcacaaaauacagacccccugccaagcugcugaaagagcggggguuuuucggagccaucgcuggcuuucucgaagggggcugggaaggaaugauugcgggcuggcacggguauaccagccauggagcccacggcguggcuguugccgccgaccugaaguccacacaggaggcuaucaauaagaucacgaaaaaccuuaauagccugucugaacucgaggugaagaaccugcaacgccuguccggggccauggacgaacuccauaaugagauucuggagcuugaugaaaaagucgacgaucugagagcggacaccaucagcucucagauugagcucgcugugcugcuuagcaacgaaggaaucauuaauuccgaggaugaacaccuucucgcccuggagcggaagcugaaaaagaugcucggccccucugccgucgacaucgggaacggcuguuucgagacaaagcacaaaugcaaucagaccugccuggaucgcaucgcugccggaacauuuaacgcuggcgaguucagccuuccuaccuuugacucccugaauauuacggccgcgagccucaacgaugacgggcuggauaaucauaccauccugcuuuacuauucuacagccgcuuccagccucgccgugacccugaugcuggcuauuuucaucguuuacauggugucuagagacaacgucuccuguagcauuugccucuga

SEQ ID NO: 211224 - RNA, 1758 nt, Artificial Sequence; identical to SEQ ID NO: 209911
  derived and/or modified sequence opt5 from hemagglutinin__InfluenzaB__AHM01107

SEQ ID NO: 211225 - RNA, 1758 nt, Artificial Sequence
  derived and/or modified sequence opt5 from hemagglutinin__InfluenzaB__AHM01118
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcaaaagagcgggaaaacaggaaccauuaccuaccagcggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaccucaagagcacccaggaggcuaucaauaaaauuacaaagaaccuuaauucccuuagcgaacuggaggugaaaaaccuccagcgccugucuggagccauggaugagcugcauaaugaaauccucgagcuggacgaaaaggucgacgaucuuagagccgacaccauuuccagccaaaucgagcuggcugugcuccugucuaacgaaggcaucauuaauagcgaggaugagcaccuucuggcccucgaacggaaacugaagaagaugcuggggcccuccgcggucgagaucggcaacggauguuucgaaacaaaacauaagugcaaucagaccugccucgaccgcauugcugccggcacguuugaugccggggaguucucucugccuaccuuugacagccuuaacaucacagcugugucccugaaugaugacggacucgauaaccacaccauucugcuguauuacagcacagccgcuucuucccuugccguuacccucaugaucgcgauuuucguggucuauauggugagcagagacaauguuucuuguuccaucugccuguga

SEQ ID NO: 211226 - RNA, 1758 nt, Artificial Sequence; identical to SEQ ID NO: 209911
  derived and/or modified sequence opt5 from hemagglutinin__InfluenzaB__AHM01129

SEQ ID NO: 211227 - RNA, 1758 nt, Artificial Sequence
  derived and/or modified sequence opt5 from hemagglutinin__InfluenzaB__AHM01140
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucugcccauaacgugauuaaugcugagaacgccccgggcggccccuauaagaucgggacgagcggauccugcccuaaugucacaaacggcaauggguucuuugcuaccauggccugggcggugcccaaaaacgacaagaauaaaacagccaccaacccucugaccauugaagugcccuacaucuguacagagggagaggaucagauuacggucuggggcuuccacagcgacaaugaaacccagauggcuaaacuuuauggggauucuaagccgcagaaguuuacauccagcgccaacggaguuaccacacacuacgugucucaaaucggcggcuucccuaaccagaccgaggacgggggacugccccaguccggcagaaucguggucgauuauauggugcaaaagagcgggaaaacgggaacaauuaccuaccagcggggcauccuccugccucagaagguuuggugcgcuucugggcgcuccaaagugauuaagggaagccuuccccugaucggcgaagccgacugucuccaugagaaauauggcgggcugaauaaguccaagcccuacuacaccggagagcacgcgaaagccauuggcaacugcccuaucugggucaagacaccgcugaaacucgcuaaugggaccaaguauagacccccugccaaacugcuuaaggaacggggauuuuucggcgcuaucgccggguuucuggagggcggaugggaaggcaugauugccggguggcauggauacacaucucacggcgcucacgggguggcgguugccgcugaucucaagagcacgcaggaggccaucaacaaaauuaccaagaaucugaacucccuuagcgaacuggaggugaaaaaucuccagcgccugucuggagccauggacgagcugcauaacgaaauccucgagcuggaugaaaaggucgacgaccuuagagcugauacaauuuccagccaaaucgagcuggccgugcuccugucuaaugaaggcaucauuaacagcgaggacgagcaccuucuggcgcucgaacggaaacugaagaagaugcuggggcccuccgcugucgagaucggcaauggauguuucgaaaccaaacauaagugcaaccagacaugccucgaucgcauugccgccggcaccuuugacgcuggggaguucucucugccuacguuugauagccuuaauaucaccgccgcuucccugaacgacgauggacucgacaaucacacaauucugcuguauuacagcaccgccgcgucuucccuugccgugacacucaugaucgcuauuuucguuguguauauggucagcagagauaacgugucuuguuccaucugccuguga

SEQ ID NO: 211228 - RNA, 1758 nt, Artificial Sequence; identical to SEQ ID NO: 209896
  derived and/or modified sequence opt5 from hemagglutinin__InfluenzaB__AHM01151

SEQ ID NO: 211229 - RNA, 1758 nt, Artificial Sequence
  derived and/or modified sequence opt5 from hemagglutinin__InfluenzaB__AHM01162
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccaaggacgcuccgggcggccccuauaaaaucgggacaagcggauccugcccuaacgucaccaauggcaacggguucuuugccacaauggcuugggccgugcccaagaaugauaaaaacaagaccgcgaccaauccucugacaauugaggugcccuacaucuguacggaaggagaggaccagauuaccgucuggggcuuccacagcgauaacgagacacagauggccaaacuuuauggggacucuaaaccgcagaaguuuaccuccagcgcuaauggaguuacaacccacuacgugucucaaaucggcggcuucccuaaccagacggaagaugggggacugccccaguccggcagaaucguggucgacuauauggugcagaaaagcgggaagacaggaaccauuaccuaccaacggggcauccuccugccucagaaaguuuggugcgccucugggcgcuccaaggugauuaaaggaagccuuccccugaucggcgaggcugauugucuccaugaaaaguauggcgggcugaacaaguccaaacccuacuacacaggagagcacgccaaggcgauuggcaauugcccuaucugggucaaaaccccgcugaagcucgccaacgggacaaaauauagacccccugcuaagcugcuuaaggagcggggauuuuucggcgccaucgcuggguuucuggaaggcggaugggagggcaugauugccggguggcauggauacacgucucacggcgcccacgggguggcuguugcggccgaccucaaaagcacccaggaagcuaucaauaagauuacaaagaaccuuaauucccugagcgagcuggaagugaagaaccuccagcgccugucuggagccauggaugagcugcauaaugagauccucgaacuggacgagaaagucgacgaucuuagagccgacaccauuuccagccaaaucgaacuggcugugcuccugucuaacgagggcaucauuaauagcgaagaugagcaccuucuggcccucgagcggaagcugaagaaaaugcuggggcccuccgcggucgaaaucggcaacggauguuucgagacaaagcauaaaugcaaucagaccugccucgaccgcauugcugccggcacguuugaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagcagagacaaugugucuuguuccaucugccuguga

SEQ ID NO: 211230 - RNA, 1755 nt, Artificial Sequence; identical to SEQ ID NO: 209878
  derived and/or modified sequence opt5 from hemagglutinin__InfluenzaB__AHM01173

SEQ ID NO: 211231 - RNA, 1758 nt, Artificial Sequence
  derived and/or modified sequence opt5 from hemagglutinin__InfluenzaB__AHM01184
augaaggccaucauugugcugcucauggucguuaccagcaacgcugacagaaucugcacaggcauuacguccucuaauagcccccacguggugaaaaccgccacacagggggaggucaacgugaccggaguuaucacacugaccacaaccccuacgaagucccauuucgcgaaucuuaaaggcaccgaaacacgggggaagcuguguccgaaaugccucaacuguaccgaucuggacguggcucuuggacgccccaagugcacaggcaagauuccuucugccagagucagcauccugcacgaggugcggcccguuaccuccggguguuuuccuaucaugcaugaucgcacgaaaauuagacaacuccccaaucugcugcggggauacgaacacauccgccucucuacacauaacgugauuaaugccgaggacgcuccuggcggcccguauaagaucgggaccagcggauccugccccaacgucacaaauggcaacggguucuuugccaccauggcuugggccgugccuaaaaaugauaagaacaaaaccgcgacaaauccccugacgauugaagugccuuacaucuguaccgagggagaggaccagauuacagucuggggcuuccacagcgauaacgaaacccagauggccaagcuguauggggacucuaagccccagaaauuuacauccagcgcuaauggaguuaccacgcacuacgugucucaaaucggcggcuucccgaaccagacagaggaugggggacugccucaguccggcagaaucguggucgacuauauggugcaaaagagcgggaaaaccggaaccauuacauaccagcggggcauccuccugccccagaagguuuggugcgccucugggcgcuccaaagugauuaagggaagccuuccucugaucggcgaagcugauugucuccaugagaaauauggcgggcugaacaaguccaagcccuacuacaccggagagcacgccaaagcgauuggcaauugccccaucugggucaagacaccucugaaacucgccaacgggacgaaguauagaccgcccgcuaaacugcuuaaggaacggggauuuuucggcgccaucgcuggguuucuggagggcggaugggaaggcaugauugccggguggcauggauacaccucucacggcgcccacgggguggcuguugcggccgaccucaagagcacacaggaggcuaucaauaaaauuaccaagaaccuuaauucccuuagcgaacuggaggugaaaaaccuccagcgccugucuggagccauggaugagcugcauaaugaaauccucgagcuggacgaaaaggucgacgaucuuagagccgacacaauuuccagccaaaucgagcuggcugugcuccugucuaacgaaggcaucauuaauagcgaggaugagcaccuucuggcccucgaacggaaacugaagaagaugcuggggccuuccgcggucgagaucggcaacggauguuucgaaaccaaacauaagugcaaucagacgugccucgaccgcauugcugccggcaccuuugaugccggggaguucucucugcccacauuugacagccuuaacaucaccgcugccucccugaaugaugacggacucgauaaccacacaauucugcuguauuacagcaccgcugccucuucccuugcggugacgcucaugaucgccauuuucguuguguauauggucagcagagacaaugugucuuguuccaucugccuguga

SEQ ID NO: 211232 - RNA, 1758 nt, Artificial Sequence; identical to SEQ ID NO: 211227
  derived and/or modified sequence opt5 from hemagglutinin__InfluenzaB__AHM01195

SEQ ID NO: 211233 - RNA, 1758 nt, Artificial Sequence
  derived and/or modified sequence opt5 from hemagglutinin__InfluenzaB__AHM01206
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcagaaaagcgaaaagacagggaccauuaccuaccaacggggaauccuccugccucagaagguuuggugcgccucuggccgcuccaaagugauuaaggggagccuuccccugaucggagaggcugauugucuccaugagaaauauggcggccugaacaaguccaagcccuacuacacaggggaacacgccaaagcgauuggaaauugcccuaucugggucaagaccccgcugaaacucgccaacggcacaaaguauagacccccugcuaaacugcuuaaggagcggggguuuuucggagccaucgcuggcuuucuggaagggggcugggagggaaugauugccggcuggcauggguacacgucucacggagcccacggcguggcuguugcggccgaccucaagagcacccaggaagcuaucaauaaaauuacaaagaaccuuaauucccuuagcgagcuggaggugaaaaaccuccagcgccugucuggggccauggaugaacugcauaaugagauccucgaacuggacgagaaggucgacgaucuuagagccgacaccauuuccagccaaaucgaacuggcugugcuccugucuaacgagggaaucauuaauagcgaggaugaacaccuucuggcccucgagcggaaacugaagaagaugcugggccccuccgcggucgaaaucgggaacggcuguuucgagacaaaacauaagugcaaucagaccugccucgaccgcauugcugccggaacguuugaugccggcgaguucucucugccuaccuuugacagccuuaacaucacagcugccucccugaaugaugacgggcucggaaaccacaccauucugcuguauuacagcacagcugccucuucccuugcggugacccucaugaucgccauuuucguuguguauauggucagcagagauaaugugucuuguuccaucugccuguga

SEQ ID NO: 211234 - RNA, 1758 nt, Artificial Sequence; identical to SEQ ID NO: 209896
  derived and/or modified sequence opt5 from hemagglutinin__InfluenzaB__AHM01217

SEQ ID NO: 211235 - RNA, 1755 nt, Artificial Sequence; identical to SEQ ID NO: 209878
  derived and/or modified sequence opt5 from hemagglutinin__InfluenzaB__AHM01228

SEQ ID NO: 211236 - RNA, 1758 nt, Artificial Sequence; identical to SEQ ID NO: 209911
  derived and/or modified sequence opt5 from hemagglutinin__InfluenzaB__AHM01239

SEQ ID NO: 211237 - RNA, 1758 nt, Artificial Sequence; identical to SEQ ID NO: 209911
  derived and/or modified sequence opt5 from hemagglutinin__InfluenzaB__AHM01250

SEQ ID NO: 211238 - RNA, 1758 nt, Artificial Sequence
  derived and/or modified sequence opt5 from hemagglutinin__InfluenzaB__AHM01261
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccaucuggggcuuccacagcgacaaugaaacacagauggccaaacuuuauggggauucuaacccgcagaaguuuaccuccagcgcuaacggagucacaacccacuacguuucucaaaucggcggcuucccuaaucagacggaggacgggggacugccccaguccggcagaauugugguggauuauaugguccagaaaagcgggaagacaggaaccaucaccuaccaacggggcauucuccugccucagaaaguguggugcgccgggggacgcucuaagguuaucaaaggcucccuuccccugauuggcgaagcugacugucuccaugagaaguaugggggacugaacaaaagcaagcccuacuacacaggcgagcacgccaaggcgaucgggaauugcccuaucugggugaaaaccccgcugaagcucgccaacggaacaaaauauagacccccugcuaagcugcuuaaagaacggggcuuuuucggggccauugcuggcuuucuggagggaggcugggaagggaugaucgccggauggcauggcuacacgucccacggggcccacggagucgcuguggcggccgaucucaagucuacccaggaggcuauuaauaagaucacaaagaaccugaauagccuuuccgaacuggagguuaagaaccuccagcgccugagcggcgccauggacgagcugcauaaugaaauucucgagcuggaugaaaaaguggacgaccuuagagccgauaccaucucuucccaaaucgagcuggcuguccuccugagcaacgaagggauuaucaauucugaggacgagcaccuucuggcccucgaacggaagcugaaaaagaugcugggccccagcgcgguggagauuggaaacggcuguuucgaaacaaagcauaaaugcaaucagaccugccucgaucgcaucgcugccgggacguuugacgccggagaguucucccugccuaccuuugauucucuuaacauuacagcugccagccugaaugacgauggccucgacaaccacaccauccugcuguauuacuccacagcugccagcucucuugcggucacccucaugauugccaucuucgugguuuauaugguguccagagauaacgucagcuguucuaucugccuguga

SEQ ID NO: 211239 - RNA, 1755 nt, Artificial Sequence; identical to SEQ ID NO: 209878
  derived and/or modified sequence opt5 from hemagglutinin__InfluenzaB__AHM01272

SEQ ID NO: 211240 - RNA, 1758 nt, Artificial Sequence; identical to SEQ ID NO: 211227
  derived and/or modified sequence opt5 from hemagglutinin__InfluenzaB__AHM01283

SEQ ID NO: 211241 - RNA, 1758 nt, Artificial Sequence; identical to SEQ ID NO: 211227
  derived and/or modified sequence opt5 from hemagglutinin__InfluenzaB__AHM01294

SEQ ID NO: 211242 - RNA, 1755 nt, Artificial Sequence; identical to SEQ ID NO: 209878
  derived and/or modified sequence opt5 from hemagglutinin__InfluenzaB__AHM01305

SEQ ID NO: 211243 - RNA, 1758 nt, Artificial Sequence; identical to SEQ ID NO: 209911
  derived and/or modified sequence opt5 from hemagglutinin__InfluenzaB__AHM01316

SEQ ID NO: 211244 - RNA, 1758 nt, Artificial Sequence; identical to SEQ ID NO: 211227
  derived and/or modified sequence opt5 from hemagglutinin__InfluenzaB__AHM01327

SEQ ID NO: 211245 - RNA, 1758 nt, Artificial Sequence; identical to SEQ ID NO: 209911
  derived and/or modified sequence opt5 from hemagglutinin__InfluenzaB__AHM01338

SEQ ID NO: 211246 - RNA, 1758 nt, Artificial Sequence; identical to SEQ ID NO: 209911
  derived and/or modified sequence opt5 from hemagglutinin__InfluenzaB__AHM01349

SEQ ID NO: 211247 - RNA, 1758 nt, Artificial Sequence
  derived and/or modified sequence opt5 from hemagglutinin__InfluenzaB__AHM01360
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacgaagggagaggaucagauuaccgucuggggcuuccacagcgacaaugagacacagauggccaagcuguauggggauucuaacccgcagaaauuuaccuccagcgcuaacggaguuacaacccacuacgugucucaaaucggcggcuucccuaaucagacggaagacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaggcugacugucuccaugaaaaauauggcgggcugaacaaguccaagcccuacuacacaggagagcacgccaaagcgauuggcaauugcccuaucugggucaagaccccgcugaaacucgccaacgggacaaaguauagacccccugcuaaacugcuuaaggagcggggauuuuucggcgccaucgcuggguuucuggaaggcggaugggagggcaugauugccggguggcauggauacacgucucacggcgcccacgggguggcuguugcggccgaucucaagagcacccaggaagcuaucaauaaaauuacaaagaaccuuaauucccuuagcgagcuggaagugaaaaaccuccagcgccugucuggagccauggacgagcugcauaaugagauccucgaacuggaugagaaggucgacgaccuuagagccgauaccauuuccagccaaaucgaacuggcugugcuccugucuaacgagggcaucauuaauagcgaagacgagcaccuucuggcccucgagcggaaacugaagaagaugcuggggcccuccgcggucgaaaucggcaacggauguuucgagacaaaacauaagugcaaucagaccugccucgaucgcauugcugccggcacguuugacgccggggaguucucucugccuaccuuugauagccuuaacaucacagcugccucccugaaugacgauggacucgacaaccacaccauucugcuguauuacagcacagcugccucuucccuugcggugacccucaugaucgccauuuucguuguguauauggucagcagagauaacgugucuuguuccaucugccuguga

SEQ ID NO: 211248 - RNA, 1755 nt, Artificial Sequence
  derived and/or modified sequence opt5 from hemagglutinin__InfluenzaB__AHM01371
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagaauggcuucuuugcgaccauggccugggcugucccuaaagacaacaauaagaacgccaccaauccccuuacaguggaggugccuuauauuugugcugaaggggaggaucagaucgccgucuggggauuccauucugacaacaaaacgcagaugaagaaucuguacggcgauuccaacccccaaaaguuuaccagcucugcgaacgggguuacaacccacuaugugucccagauuggaggcuucccggaccagacagaggauggcgggcucccucagagcggaagaaucguggucgacuacaugaugcaaaaacccggcaagaccgggacgauuguguaucagcggggaguucugcuuccucagaaaguguggugcgccucuggccgcuccaaggucaucaaagggagccugccccucaucggagaagcugauugucugcaugagaaguacggcggccugaauaaauccaagcccuacuauacaggggaacacgccaaggcuauuggaaacugcccuaucugggugaaaaccccgcucaagcuggccaauggcaccaaauacagacccccugccaagcugcugaaagagcggggguuuuucggagcuauugcgggcuuucucgaagggggcugggaaggaaugaucgccggcuggcacggguauacaucucauggagcucacggcguugccguggccgcugaccugaaaagcacccaggaggccauuaacaagaucacaaagaaucuuaacucccugagcgaacucgaggucaagaaucugcaacgccugucuggggcgauggacgaacuccauaacgagauccuggagcuugaugaaaaaguggacgaucugagagcugacacgauuuccagccagaucgagcucgccguccugcuuucuaaugaaggaauuaucaacagcgaggaugaacaccuucucgcccuggagcggaagcugaaaaagaugcucggccccuccgcuguggacauugggaauggcuguuucgagaccaagcacaaaugcaaccagacaugccuggaucgcaucgccgcuggaaccuuuaaugccggcgaguucucucuuccuacauuugacagccugaacaucaccgcggccucccucaaugaugacgggcuggauaaccauacgauucugcuuuacuauagcaccgcugccucuucccucgcuguuacacugaugcuggccaucuucauuguguacauggucagcagagacaacgugucuuguuccaucugccucuga

SEQ ID NO: 211249 - RNA, 1755 nt, Artificial Sequence; identical to SEQ ID NO: 209878
  derived and/or modified sequence opt5 from hemagglutinin__InfluenzaB__AHM01382

SEQ ID NO: 211250 - RNA, 1758 nt, Artificial Sequence
  derived and/or modified sequence opt5 from hemagglutinin__InfluenzaB__AHM01393
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaaugugaccaacggcaauggguucuuugccacaauggcuugggccguccccaaaaacgacaagaauaaaaccgcgaccaacccucugacaaucgaagugcccuacauuuguacggagggagaggaucagaucaccguguggggcuuccacagcgacaaugaaacacagauggccaaacuuuauggggauucuaagccgcagaaguuuaccuccagcgcuaacggagucacaacccacuacguuucucaaaucggcggcuucccuaaccagacggaggacgggggacugccccaguccggcagaauugugguggauuauaugguccaaaagagcgggaaaacaggaaccaucaccuaccagcggggcauucuccugccucagaagguguggugcgccucugggcgcuccaaaguuaucaagggaagccuuccccugauuggcgaagcugacugucuccaugagaaauauggcgggcugaauaaguccaagcccuacuacacaggagagcacgccaaagcgaucggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaucucaagagcacccaggaggcuauuaacaaaaucacaaagaaucugaacucccuuagcgaacuggagguuaaaaaucuccagcgccugucuggagccauggacgagcugcauaacgaaauucucgagcuggaugaaaagguggacgaccuuagagccgauaccaucuccagccaaaucgagcuggcuguccuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugauugccaucuucgugguuuauauggugagcagagauaacgucucuuguuccaucugccuguga

SEQ ID NO: 211251 - RNA, 1758 nt, Artificial Sequence; identical to SEQ ID NO: 209911
  derived and/or modified sequence opt5 from hemagglutinin__InfluenzaB__AHM01404

SEQ ID NO: 211252 - RNA, 1758 nt, Artificial Sequence
  derived and/or modified sequence opt5 from hemagglutinin__InfluenzaB__AHM01415
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucgugauugacuauaugguccaaaagagcgggaaaacaggaaccaucaccuaccagcggggcauucuccugccucagaagguguggugcgccucugggcgcuccaaaguuaucaagggaagccuuccccugauuggcgaagcugauugucuccaugagaaauauggcgggcugaacaaguccaagcccuacuacacaggagagcacgccaaagcgaucggcaauugcccuaucugggugaagaccccgcugaaacucgccaacgggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaccucaagagcacccaggaggcuauuaauaaaaucacaaagaaccuuaauucccuuagcgaacuggagguuaaaaaccuccagcgccugucuggagccauggaugagcugcauaaugaaauucucgagcuggacgaaaagguggacgaucuuagagccgacaccaucuccagccaaaucgagcuggcuguccuccugucuaacgaaggcauuaucaauagcgaggaugagcaccuucuggcccucgaacggaaacugaagaagaugcuggggcccuccgcgguggagauuggcaacggauguuucgaaacaaaacauaagugcaaucagaccugccucgaccgcaucgcugccggcacguuugaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaaugucucuuguuccaucugccuguga

SEQ ID NO: 211253 - RNA, 1758 nt, Artificial Sequence
  derived and/or modified sequence opt5 from hemagglutinin__InfluenzaB__AHM01426
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccaucuggggcuuccacagcgacaaugaaacacagauggccaaacuuuauggggauucuaacccgcagaaguuuaccuccagcgcuaacggagucacaacccacuacguuucucaaaucggcggcuucccuaaucagacggaggacgggggacugccccaguccggcagaauugugguggauuauaugguccagaaaagcgggaagacaggaaccaucaccuaccaacggggcauucuccugccucagaaaguguggugcgccucugggcgcuccaagguuaucaaaggaagccuuccccugauuggcgaagcugacugucuccaugagaaguauggcgggcugaacaaauccaagcccuacuacacaggagagcacgccaaggcgaucggcaauugcccuaucugggugaaaaccccgcugaagcucgccaacgggacaaaauauagacccccugcuaagcugcuuaaagaacggggauuuuucggcgccauugcuggguuucuggagggcggaugggaaggcaugaucgccggguggcauggauacacgucucacggcgcccacggggucgcuguggcggccgaucucaagagcacccaggaggcuauuaauaagaucacaaagaaccuuaauucccugagcgaacuggagguuaagaaccuccagcgccugucuggagccauggacgagcugcauaaugaaauucucgagcuggaugaaaaaguggacgaccuuagagccgauaccaucuccagccaaaucgagcuggcuguccuccugucuaacgaaggcauuaucaauagcgaggacgagcaccuucuggcccucgaacggaagcugaaaaagaugcuggggcccuccgcgguggagauuggcaacggauguuucgaaacaaagcauaaaugcaaucagaccugccucgaucgcaucgcugccggcacguuugacgccggggaguucucucugccuaccuuugauagccuuaacauuacagcugccucccugaaugacgauggacucgacaaccacaccauccugcuguauuacagcacagcugccucuucccuugcggucacccucaugauugccaucuucgugguuuauauggugagcagagauaacgucucuuguuccaucugccuguga

SEQ ID NO: 211254 - RNA, 1755 nt, Artificial Sequence
  derived and/or modified sequence opt5 from hemagglutinin__InfluenzaB__AHM01437
augaaggccgugaucguccugcucaugguugugaccagcaacgcugacagaauuugcacaggcaucacguccucuaauagcccccacguggucaaaaccgccacacagggggaggugaacguuaccggagugauuccucugacaaccacaccgaccaaguccuacuucgcgaaucuuaaaggcacgaagacccgggggaaacugugucccgauugccucaacuguacagaccuggaugucgcucuuggacgcccuaugugcgugggcaccacacccucugccaaggccagcauccugcaugaaguuagaccugugaccuccggguguuuucccauuaugcacgaccggacgaagauccgccaacucgcuaaucugcugagaggauaugagaacauccggcucucuacacagaaugucauugaugccgaaaaagcuccuggcggcccguaccgccuggggaccagcggauccugccccaacgccacaagcaagucuggcuucuuugcgaccauggccugggcugugccuaaagacaauaacaagaaugccaccaacccccuuacaguggaggucccuuauaucugugcugaagaggaggaucagauuacgguuuggggguuccauuccgacaauaaaacccagaugaagaaccuguacggagauagcaauccccaaaaguuuacaucuuccgccaacggcgugaccacacacuaugugagccagaucgggggauucccggaccagaccgaagauggcggccucccucagucugggagaauugucguggacuacaugaugcaaaaacccggaaagacgggcacaaucguuuaucagcgcggggugcugcuuccucagaaagucuggugcgcguccggacggagcaaggugauuaaaggcucccugccccucaucggggaggccgauugucugcaugaaaaguacggaggccugaacaaaucuaagcccuacuauaccggcgagcacgcuaaggccaucgggaauugcccuauuuggguuaaaaccccgcucaagcuggcuaacggaacaaaauacagacccccugccaagcugcugaaagagcggggcuuuuucggggccaucgcuggauuucucgaaggcgggugggagggcaugauugcgggauggcacggcuauaccagccauggggcccacggaguggcugucgccgccgaccugaaguccacacaggaagcuaucaauaagauuacgaaaaaccuuaauagccugucugagcucgaagugaagaaccugcaacgccuguccggcgccauggacgagcuccauaaugagauccuggaacuugaugagaaagucgacgaucugagagcggacaccaucagcucucagauugaacucgcugugcugcuuagcaacgaggggaucauuaauuccgaagaugagcaccuucucgcccuggagcggaagcugaaaaagaugcucggacccucugccguugacaucggcaacggguguuucgaaacaaagcacaaaugcaaucagaccugccuggaucgcauugcugccggcacauuuaacgcuggagaguucagccuuccuaccuuugacucccugaauaucacggccgcgagccucaacgaugacggccuggauaaucauaccauccugcuuuacuauucuacagccgcuuccagccucgccgugacccugaugcuggcuauuuucaucgucuacauggugucuagagacaacguuuccuguagcauuugccucuga

SEQ ID NO: 211255 - RNA, 1755 nt, Artificial Sequence
  derived and/or modified sequence opt5 from hemagglutinin__InfluenzaB__AHM01448
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacagcugaggugccuuauauuugugccgaaggggaggaucagaucacgguguggggauuccauuccgacaauaaaacccagaugaagaaccuguacggcgauagcaauccccaaaaguuuacaucuuccgcgaacggggucaccacacacuauguuagccagauuggaggcuucccggaccagaccgaggauggcgggcucccucagucuggaagaaucgugguggacuacaugaugcaaaaacccggcaagacggggacaauugucuaucagcggggagugcugcuuccucagaaaguuuggugcgccuccggccgcagcaaggugaucaaagggucccugccccucaucggagaagcugauugucugcaugagaaguacggcggccugaacaaaucuaagcccuacuauaccggggaacacgccaaggcuauuggaaauugcccuaucugggucaaaaccccgcucaagcuggccaacggcacaaaauacagacccccugccaagcugcugaaagagcggggguuuuucggagcuauugcgggcuuucucgaagggggcugggaaggaaugaucgccggcuggcacggguauaccagccauggagcucacggcguggccguugccgcugaccugaaguccacacaggaggccauuaauaagaucacgaaaaaccuuaauagccugucugaacucgaggugaagaaccugcaacgccuguccggggcgauggacgaacuccauaaugagauccuggagcuugaugaaaaagucgacgaucugagagcugacaccauuagcucucagaucgagcucgccgugcugcuuagcaacgaaggaauuaucaauuccgaggaugaacaccuucucgcccuggagcggaagcugaaaaagaugcucggccccucugcugucgacauugggaacggcuguuucgagacaaagcacaaaugcaaucagaccugccuggaucgcaucgccgcuggaacauuuaacgccggcgaguucagccuuccuaccuuugacucccugaauaucacggcggccagccucaacgaugacgggcuggauaaucauaccauucugcuuuacuauucuacagcugccuccagccucgcugugacccugaugcuggccaucuucauuguuuacauggugucuagagacaacgucuccuguagcaucugccucuga

SEQ ID NO: 211256 - RNA, 1758 nt, Artificial Sequence; identical to SEQ ID NO: 209669
  derived and/or modified sequence opt5 from hemagglutinin__InfluenzaB__AHM01459

SEQ ID NO: 211257 - RNA, 1755 nt, Artificial Sequence
  derived and/or modified sequence opt5 from hemagglutinin__InfluenzaB__AHM01470
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuuguacggaaggggaggaucagaucgcugucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugaucgcgggcuggcacggguauaccagccauggagcccacggcguugcuguggccgccgaccugaaguccacacaggaggcugucaauaagauuacgaaaaaccuuaauagccugucugaacucgaggugaagaaccugcaacgccuguccggggccauggacgaacuccauaaugagauccuggagcuugaugaaaaagucgacgaucugagagcggacaccaucagcucucagauugagcucgcugugcugcuuagcaacgaaggaaucauuaauuccgaggaugaacaccuucucgcccuggagcggaagcugaaaaagaugcucggccccucugccguugacaucgggaacggcuguuucgagacaaagcacaaaugcaaucagaccugccuggaucgcauugcugccggaacauuuaacgcuggcgaguucagccuuccuaccuuugacucccugaauaucacggccgcgagccucaacgaugacgggcuggauaaucauaccauccugcuuuacuauucuacagccgcuuccagccucgccgugacccugaugcuggcuauuuucaucgucuacauggugucuagagacaacguuuccuguagcauuugccucuga

SEQ ID NO: 211258 - RNA, 1755 nt, Artificial Sequence
  derived and/or modified sequence opt5 from hemagglutinin__InfluenzaB__AHM01481
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagcgcguguggugcgcguccggcagaagcaaagucaucaaggggucccugccccucaucggagaagccgauugucugcaugagaaauacggcggccugaacaagucuaaacccuacuauaccggggaacacgcuaaggccauuggaaauugcccuaucugggugaagaccccgcucaaacuggcuaacggcacaaaguaccggcccccugccaaacuucugaaggagcgcggguuuuucggagccauugcuggcuuucucgaagggggcugggaaggaaugaucgcgggcuggcacggguauaccagccauggagcccacggcguugcuguggccgccgaccugaaauccacacaggaggcuauuaauaagaucacgaagaaccuuaauagccugucugaacucgaggucaaaaaccugcaaagacuguccggggccauggacgaacuccauaaugagauccuggagcuugaugaaaagguggacgaucugcgggcggacaccauuagcucucagaucgagcucgcuguccugcuuagcaacgaaggaauuaucaauuccgaggaugaacaucugcucgcccuggagcgcaaacugaagaaaaugcucggccccucugccguggacauugggaacggcuguuucgagacaaagcacaagugcaaucagaccugccuggauagaaucgcugccggaacauuuaacgcuggcgaguucagccuuccuaccuuugacucccugaauaucacggccgcgagccucaacgaugacgggcuggauaaucacaccauucugcuuuacuauucuacagccgcuuccagccucgccguuacccugaugcuggcuaucuucauuguguacauggucucucgggacaacguguccuguagcaucugccucuga

SEQ ID NO: 211259 - RNA, 1755 nt, Artificial Sequence; identical to SEQ ID NO: 209923
  derived and/or modified sequence opt5 from hemagglutinin__InfluenzaB__AHM01492

SEQ ID NO: 211260 - RNA, 1755 nt, Artificial Sequence; identical to SEQ ID NO: 209878
  derived and/or modified sequence opt5 from hemagglutinin__InfluenzaB__AHM01503

SEQ ID NO: 211261 - RNA, 1755 nt, Artificial Sequence; identical to SEQ ID NO: 209878
  derived and/or modified sequence opt5 from hemagglutinin__InfluenzaB__AHM01514

SEQ ID NO: 211262 - RNA, 1755 nt, Artificial Sequence
  derived and/or modified sequence opt5 from hemagglutinin__InfluenzaB__AHM01525
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugauucaaaaacccggcaagacggggacaaucguguaucagcggggaguucugcuuccucagaaaguguggugcgcguccggccgcagcaaggucaucaaagggucccugccccucauuggagaagccgauugucugcaugagaaguacggcggccugaacaaaucuaagcccuacuauaccggggaacacgcuaaggccaucggaaauugcccuauuugggugaaaaccccgcucaagcuggcuaacggcacaaaauacagacccccugccaagcugcugaaagagcggggguuuuucggagccaucgcuggcuuucucgaagggggcugggaaggaaugauugcgggcuggcacggguauaccagccauggagcccacggcguugcuguggccgccgaccugaaguccacacaggaggcuaucaauaagaucacgaaaaaccuuaauagccugucugaacucgaggucaagaaccugcaacgccuguccggggccauggacgaacuccauaaugagauucuggagcuugaugaaaaaguggacgaucugagagcggacaccaucagcucucagauugagcucgcuguccugcuuagcaacgaaggaaucauuaauuccgaggaugaacaccuucucgcccuggagcggaagcugaaaaagaugcucggccccucugccguggacaucgggaacggcuguuucgagacaaagcacaaaugcaaucagaccugccuggaucgcaucgcugccggaacauuuaacgcuggcgaguucagccuuccuaccuuugacucccugaauauuacggccgcgagccucaacgaugacgggcuggauaaucauaccauccugcuuuacuauucuacagccgcuuccagccucgccguuacccugaugcuggcuauuuucaucguguacauggucucuagagacaacguguccuguagcauuugccucuga

SEQ ID NO: 211263 - RNA, 1755 nt, Artificial Sequence
  derived and/or modified sequence opt5 from hemagglutinin__InfluenzaB__AHM01536
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccggcaagacggggacaauuguguaucagcggggaguucugcuuccucagaaaguguggugcgcguccggccgcagcaaggucaucaaagggucccugccccucaucggagaagccgauugucugcaugagaaguacggcggccugaacaaaucuaagcccuacuauaccggggaacacgcuaaggccauuggaaauugcccuaucugggugaaaaccccgcucaagcuggcuaacggcacaaaauacagacccccugccaagcugcugaaagagcggggguuuuucggagccauugcuggcuuucucgaagggggcugggaaggaaugaucgcgggcuggcacggguauaccagccauggaguucacggcguggccgucgcugccgaccugaaguccacacaggaggccauuaauaagaucacgaaaaaccuuaauagccugucugaacucgaggugaagaaccugcaacgccuguccggggcuauggacgaacuccauaaugagauccuggagcuugaugaaaaagucgacgaucugagagccgacaccauuagcucucagaucgagcucgcggugcugcuuagcaacgaaggaauuaucaauuccgaggaugaacaccuucucgcucuggagcggaagcugaaaaagaugcucggccccucugccguugacauugggaacggcuguuucgagacaaagcacaaaugcaaucagaccugccuggaucgcaucgccgcuggaacauuuaacgccggcgaguucagccuuccuaccuuugacucccugaauaucacggcugccagccucaacgaugacgggcuggauaaucauaccauucugcuuuacuauucuacagcggccuccagccucgcugugacccugaugcuggccaucuucauugucuacauggugucuagagacaacguuuccuguagcaucugccucuga

SEQ ID NO: 211264 - RNA, 1755 nt, Artificial Sequence; identical to SEQ ID NO: 209878
  derived and/or modified sequence opt5 from hemagglutinin__InfluenzaB__AHM01547

SEQ ID NO: 211265 - RNA, 1755 nt, Artificial Sequence; identical to SEQ ID NO: 209923
  derived and/or modified sequence opt5 from hemagglutinin__InfluenzaB__AHM01558

SEQ ID NO: 211266 - RNA, 1758 nt, Artificial Sequence; identical to SEQ ID NO: 209764
  derived and/or modified sequence opt5 from hemagglutinin__InfluenzaB__AHV83951

SEQ ID NO: 211267 - RNA, 1755 nt, Artificial Sequence; identical to SEQ ID NO: 211153
  derived and/or modified sequence opt5 from hemagglutinin__InfluenzaB__AHV83952

SEQ ID NO: 211268 - RNA, 1758 nt, Artificial Sequence; identical to SEQ ID NO: 209707
  derived and/or modified sequence opt5 from hemagglutinin__InfluenzaB__AHZ36697

SEQ ID NO: 211269 - RNA, 1758 nt, Artificial Sequence
  derived and/or modified sequence opt5 from hemagglutinin__InfluenzaB__AHZ36708
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugccugaaugucaccaacggcaauggguucuuugccacaauggcuugggccgugccuaaaaacgacaagaauaaaaccgcgaccaacccccuuacaauugaagugccuuacaucuguacggagggagaggaucagauuaccgucuggggcuuccacagcgacaaugaaacacagauggccaagcuguauggggauucuaagccccagaaauuuaccuccagcgcuaacggaguuacaacccacuacgugucucaaaucggcggcuucccgaaccagacggaggacgggggacucccucaguccggcagaaucguggucgauuauauggugcaaaagagcgggaaaacaggaaccauuaccuaccagcggggcauccugcuuccccagaagguuuggugcacaucugggcgcuccaaagugauuaagggaagccugccucucaucggcgaagccgacugucugcaugagaaauauggcgggcugaauaaguccaagcccuacuacaccggagagcacgcuaaagccauuggcaacugccccaucugggucaagacaccucucaaacuggcgaaugggacgaaguauagaccgcccgccaaacuucugaaggaacggggauuuuucggcgcuaucgccggguuucucgagggcggaugggaaggcaugauugcuggguggcauggauacaccucucacggcgcccacgggguggccguugcugcggaucuuaagagcacacaggaggccaucaacaaaauuaccaagaaucugaacucccugagcgaacucgaggugaaaaaucugcagcgccugucuggagcuauggacgagcuccauaacgaaauccuggagcuugaugaaaaggucgacgaccugagagccgauacaauuuccagccaaaucgagcucgccgugcugcuuucuaaugaaggcaucauuaacagcgaggacgagcaucugcucgcucuggaacggaaacugaagaagaugcucgggccuuccgccgucgagaucggcaauggauguuucgaaaccaaacacaagugcaaccagacgugccuggaucgcauugcggcuggcaccuuugacgccggggaguucucucuucccacauuugauagccugaauaucaccgccgcuucccucaacgacgauggacuggacaaucacacaauucugcuuuauuacagcaccgccgcuucuucccucgccgugacgcugaugaucgcgauuuucguuguguauauggucagcagagauaacgugucuuguuccaucugccuguga

SEQ ID NO: 211270 - RNA, 1758 nt, Artificial Sequence
  derived and/or modified sequence opt5 from hemagglutinin__InfluenzaB__AHZ36719
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacgucuguacggagggagaggaucagaucaccguuuggggcuuccacagcgacaaugaaacacagauggccaaacuuuauggggauucuaagccgcagaaguuuaccuccagcgcuaacggagugacaacccacuacgugucucaaauuggcggcuucccuaaccagacggaggacgggggacugccccaguccggcagaaucgucguggauuauaugguucaaaagagcgggaaaacaggaaccaucaccuaccagcggggcauucuccugccucagaagguguggugcgccucugggcgcuccaaagucaucaagggaagccuuccccugauuggcgaagcugacugucuccaugagaaauauggcgggcugaauaaguccaagcccuacuacacaggagagcacgccaaagcgaucggcaacugcccuauuugggugaagaccccgcugaaacucgccaaugggacaaaguauagacccccugcuaaacugcuuaaggaacggggauuuuucggcgccaucgcuggguuucuggagggcggaugggaaggcaugaucgccggguggcauggauacacgucucacggcgcccacgggguugcuguggcggccgaucucaagagcacccaggaggcuauuaacaaaaucacaaagaaucugaacucccuuagcgaacuggaggucaaaaaucuccagcgccugucuggagccauggacgagcugcauaacgaaauucucgagcuggaugaaaagguggacgaccuuagagccgauaccaucuccagccaaauugagcuggcuguccuccugucuaaugaaggcaucaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcgguuacccucaugauugccaucuucguggucuauauggugagcagagauaacguuucuuguuccauuugccuguga

SEQ ID NO: 211271 - RNA, 1758 nt, Artificial Sequence; identical to SEQ ID NO: 209707
  derived and/or modified sequence opt5 from hemagglutinin__InfluenzaB__AHZ36730

SEQ ID NO: 211272 - RNA, 1758 nt, Artificial Sequence; identical to SEQ ID NO: 209707
  derived and/or modified sequence opt5 from hemagglutinin__InfluenzaB__AHZ36752

SEQ ID NO: 211273 - RNA, 1758 nt, Artificial Sequence; identical to SEQ ID NO: 209669
  derived and/or modified sequence opt5 from hemagglutinin__InfluenzaB__AHZ36763

SEQ ID NO: 211274 - RNA, 1758 nt, Artificial Sequence
  derived and/or modified sequence opt5 from hemagglutinin__InfluenzaB__AHZ36774
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagagcgcucccggcggcccuuauaagaucgggacauccggaagcugccccaacgucaccaauggcaacggguucuuugccacaauggcuugggccgugccuaaaaaugacaagaacaaaaccgcgaccgauccccucacaauugaagugccguacaucuguacggaggaggaagaccagauuaccgucuggggauuccacucugauaaugagacacagauggccaagcuguauggcgacuccaagccucagaaauuuaccagcucugcuaacgggguuacaacccacuacgugucccaaaucggaggcuuccccaaucagacggaagauggcgggcuuccucagagcggaagaaucguggucgacuauauggugcagaagucuggcaaaacagggaccauuaccuaccaacggggaauccugcucccccagaagguuuggugcgccuccggccgcagcaaagugauuaaggggucccugccccuuaucggagaggcugauugucugcaugagaaauauggcggccucaacaagucuaagccuuacuacacaggggaacacgccaaagcgauuggaaacugcccgaucugggucaagacaccccugaaacuggccaauggcaccaaguauagaccucccgcuaaacuccugaaggagcggggguuuuucggagccaucgcuggcuuucuugaagggggcugggagggaaugauugccggcuggcauggguacacgagccacggagcccacggcguggcuguugcggccgaccugaaguccacccaggaagcuaucaacaaagugacaaagaaucucaacagccugucugagcuugaggucaaaaaucugcagcgccucuccggggccauggaugaacugcauaacgagauucuggaacucgacgagaagguggacgaucugagagccgacaccaucagcucucaaauugaacuugcuguccugcucagcaaugagggaaucaucaacuccgaggaugaacaucugcuugcccuggagcggaaacucaagaagaugcugggcccuucugcgguggaaauugggaauggcuguuucgagacaaaacacaagugcaaccagaccugccuggaccgcaucgcugccggaacguuugaugccggcgaguucagccuccccaccuuugacucccugaauauuacagcugccagccuuaacgaugacgggcuggauaaucacaccauccuccuguauuacucuacagcugccuccagccuggcgguuacccuuaugauugccaucuucguggucuauauggugucuagagacaacguuuccuguagcauuugccucuga

SEQ ID NO: 211275 - RNA, 1758 nt, Artificial Sequence; identical to SEQ ID NO: 211183
  derived and/or modified sequence opt5 from hemagglutinin__InfluenzaB__AHZ36785

SEQ ID NO: 211276 - RNA, 1758 nt, Artificial Sequence; identical to SEQ ID NO: 211183
  derived and/or modified sequence opt5 from hemagglutinin__InfluenzaB__AHZ36796

SEQ ID NO: 211277 - RNA, 1755 nt, Artificial Sequence
  derived and/or modified sequence opt5 from hemagglutinin__InfluenzaB__AHZ36807
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagaccgaggauggcgggcucccucagucuggaagaaucguggucgacuacaugaugcaaaaacccgaaaagacgggcacaauuguguaucagcgcgggguucugcuuccucagaaaguguggugcgcguccggacggagcaaggucaucaaaggcucccugccccucaucggggaggccgauugucugcaugaaaaguacggaggccugaacaaaucuaagcccuacuauaccggcgagcacgcuaaggccauugggaauugcccuaucugggugaaaaccccgcucaagcuggcuaacggaacaaaauacagacccccugccaagcugcugaaagagcggggcuuuuucggggccauugcuggauuucucgaaggcgggugggagggcaugaucgcgggauggcacggcuauaccagccauggggcccacggaguugcuguggccgccgaccugaaguccacacaggaagcuauuaauaagaucacgaaaaaccuuaauagccugucugagcucgaagucaagaaccugcaacgccuguccggcgccauggacgagcuccauaaugagauccuggaacuugaugagaaaguggacgaucugagagcggacaccauuagcucucagaucgaacucgcuguccugcuuagcaacgaggggauuaucaauuccgaagaugagcaccuucucgcccuggagcggaagcugaaaaagaugcucggacccucugccguggacauuggcaacggguguuucgaaacaaagcacaaaugcaaucagaccugccuggaucgcaucgcugccggcacauuuaacgcuggagaguucagccuuccuaccuuugacucccugaauaucacggccgcgagccucaacgaugacggccuggauaaucauaccauucugcuuuacuauucuacagccgcuuccagccucgccguuacccugaugcuggcuaucuucauuguguacauggucucuagagacaacguguccuguagcaucugccucuga

SEQ ID NO: 211278 - RNA, 1758 nt, Artificial Sequence; identical to SEQ ID NO: 209707
  derived and/or modified sequence opt5 from hemagglutinin__InfluenzaB__AHZ36818

SEQ ID NO: 211279 - RNA, 1758 nt, Artificial Sequence; identical to SEQ ID NO: 209669
  derived and/or modified sequence opt5 from hemagglutinin__InfluenzaB__AHZ36829

SEQ ID NO: 211280 - RNA, 1758 nt, Artificial Sequence; identical to SEQ ID NO: 209669
  derived and/or modified sequence opt5 from hemagglutinin__InfluenzaB__AHZ36840

SEQ ID NO: 211281 - RNA, 1758 nt, Artificial Sequence; identical to SEQ ID NO: 211183
  derived and/or modified sequence opt5 from hemagglutinin__InfluenzaB__AHZ36851

SEQ ID NO: 211282 - RNA, 1758 nt, Artificial Sequence; identical to SEQ ID NO: 209707
  derived and/or modified sequence opt5 from hemagglutinin__InfluenzaB__AHZ36862

SEQ ID NO: 211283 - RNA, 1758 nt, Artificial Sequence; identical to SEQ ID NO: 209669
  derived and/or modified sequence opt5 from hemagglutinin__InfluenzaB__AHZ36873

SEQ ID NO: 211284 - RNA, 1758 nt, Artificial Sequence
  derived and/or modified sequence opt5 from hemagglutinin__InfluenzaB__AHZ36884
augaaggccaucauugugcugcucauggucguuaccagcaacgcugacagaaucugcacaggcauuacguccucuaauagcccccacaucgugaaaaccgccacacagggggaagugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugaaacaauggccugggcugugcccaaaaacgacaagaauaaaaccgccaccaacccucugacaauugagguccccuacaucuguacggagggagaagaucagaucaccguguggggcuuccacagcgacaaugagacacagauggcgaaacuuuauggggauucuaagccgcagaaguuuaccuccagcgccaacggagugacaacccacuacgucucucaaauuggcggcuucccuaaccagacggaagacgggggacugccccaguccggcagaaucguuguggauuauauggugcaaaagagcgggaaaacaggaaccauuaccuaccagcggggcauccuccugccucagaaggucuggugcgcuucugggcgcuccaaagugauuaagggaagccuuccccugaucggcgaggccgacugucuccaugagaaauauggcgggcugaauaaguccaagcccuacuacacaggagaacacgcuaaagccaucggcaacugcccuauuuggguuaagaccccgcugaaacucgcgaaugggacaaaguauagacccccugccaaacugcuuaaggagcggggauuuuucggcgcuaucgccggguuucuggaaggcggaugggagggcaugauugcuggguggcauggauacacgucucacggcgcccacgggguggccgucgcugcggaucucaagagcacccaggaagccaucaacaaaauuacaaagaaucugaacucccuuagcgagcuggaggugaaaaaucuccagcgccugucuggagcuauggacgaacugcauaacgagauccucgaacuggaugagaagguugacgaccuuagagccgauaccaucuccagccaaauugaacuggccgugcuccugucuaaugagggcaucauuaacagcgaggacgaacaccuucuggcucucgagcggaaacugaagaagaugcuggggcccuccgccgucgaaaucggcaauggauguuucgagacaaaacauaagugcaaccagaccugccucgaucgcauugcggcuggcacguuugacgccggggaguucucucugccuaccuuugauagccuuaauaucacagccgcuucccugaacgacgauggacucgacaaucacaccauucugcuguauuacagcacagccgcuucuucccuugccgugacccucaugaucgcgaucuucgucguguauaugguuagcagagauaacgugucuuguuccauuugccuguga

SEQ ID NO: 211285 - RNA, 1758 nt, Artificial Sequence; identical to SEQ ID NO: 209707
  derived and/or modified sequence opt5 from hemagglutinin__InfluenzaB__AHZ36895

SEQ ID NO: 211286 - RNA, 1758 nt, Artificial Sequence; identical to SEQ ID NO: 209707
  derived and/or modified sequence opt5 from hemagglutinin__InfluenzaB__AHZ36906

SEQ ID NO: 211287 - RNA, 1758 nt, Artificial Sequence
  derived and/or modified sequence opt5 from hemagglutinin__InfluenzaB__AHZ36928
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacgaagacccgggggaaacugugucccaagugccucaacuguacagaucuggacguggcucuuggacgcccuaagugcaccggcaaaauucccucugccagagucagcauccugcacgaagugcggccuguuacauccggguguuuucccaucaugcaugaucgcaccaagauuagacaacucccuaaucugcugcggggauacgagcacauccgccucucuacgcauaacgugauuaaugccgaaaacgcuccgggcggccccuauaaaaucgggacaagcggauccugccugaaugucaccaacggcaauggguucuuugccacaauggcuugggccgugccuaagaacgacaaaaauaagaccgcgaccaacccccuuacaauugaggugccuuacaucuguacggaaggagaggaucagauuaccgucuggggcuuccacagcgacaaugagacacagauggccaagcuguauggggauucuaaaccccagaaguuuaccuccagcgcuaacggaguuacaacccacuacgugucucaaaucggcggcuucccgaaccagacggaagacgggggacucccucaguccggcagaaucguggucgauuauauggugcagaaaagcgggaagacaggaaccauuaccuaccaacggggcauccugcuuccccagaaaguuuggugcgccucugggcgcuccaaggugauuaaaggaagccugccucucaucggcgaggcugacugucugcaugaaaaguauggcgggcugaauaaguccaaacccuacuacacaggagagcacgccaaggcgauuggcaacugccccaucugggucaaaaccccucucaagcuggccaaugggacaaaauauagaccgcccgcuaaacuucugaaggagcggggauuuuucggcgccaucgcuggguuucucgaaggcggaugggagggcaugauugccggguggcauggauacacgucucacggcgcccacgggguggcuguugcggccgaucugaaaagcacccaggaagcuaucaacaagauuacaaagaaucuuaacucccugagcgagcucgaagugaagaaucugcagcgccugucuggagccauggacgagcuccauaacgagauccuggaacuugaugagaaagucgacgaccugagagccgauaccauuuccagccaaaucgaacucgcugugcugcuuucuaaugagggcaucauuaacagcgaagacgagcaucugcucgcccuggagcggaagcugaagaaaaugcucgggccuuccgcggucgaaaucggcaauggauguuucgagacaaagcacaaaugcaaccagaccugccuggaucgcauugcugccggcacguuugacgccggggaguucucucuucccaccuuugauagccugaauaucacagcugccucccucaacgacgauggacuggacaaucacaccauucugcuuuauuacagcacagcugccucuucccucgcggugacccugaugaucgccauuuucguuguguauauggucagcagagauaacgugucuuguuccaucugccuguga

SEQ ID NO: 211288 - RNA, 1758 nt, Artificial Sequence; identical to SEQ ID NO: 211183
  derived and/or modified sequence opt5 from hemagglutinin__InfluenzaB__AHZ36939

SEQ ID NO: 211289 - RNA, 1758 nt, Artificial Sequence
  derived and/or modified sequence opt5 from hemagglutinin__InfluenzaB__AHZ36950
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccuauuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaauauuaccaacggcaauggguucuuugccacaauggcuugggccguucccaaaaacgacaagaauaaaaccgcgaccaacccucugacaaucgaagugcccuacaucuguacggagggagaggaucagauuaccgucuggggcuuccacagcgacaaugaaacacagauggccaaacuuuauggggauucuaagccgcagaaguuuaccuccagcgcuaacggagugacaacccacuacgugucucaaaucggcggcuucccuaaccagacggaggacgggggacugccccaguccggcagaauugucguugauuauauggugcaaaagagcgggaaaacaggaaccaucaccuaccagcggggcauucuccugccucagaagguguggugcgccucugggcgcuccaaagucaucaagggaagccuuccccugaucggcgaagcugacugucuccaugagaaauauggcgggcugaauaaguccaagcccuacuacacaggagagcacgccaaagcgauuggcaacugcccuaucugggugaagaccccgcugaaacucgccaaugggacaaaguauagacccccugcuaaacugcuuaaggaacggggauuuuucggcgccauugcuggguuucuggagggcggaugggaaggcaugaucgccggguggcauggauacacgucucacggcgcccacgggguugcuguggcggccgaucucaagagcacccaggaggcuauuaacaaaaucacaaagaaucugaacucccuuagcgaacuggaggucaaaaaucuccagcgccugucuggagccauggacgagcugcauaacgaaauccucgagcuggaugaaaagguggacgaccuuagagccgauaccauuuccagccaaaucgagcuggcuguucuccugucuaaugaaggcauuaucaacagcgaggacgagcaccuucuggcccucgaacggaaacugaagaagaugcuggggcccuccgcgguggagauuggcaauggauguuucgaaacaaaacauaagugcaaccagaccugccucgaucgcaucgcugccggcacguuugacgccggggaguucucucugccuaccuuugauagccuuaauauuacagcugccucccugaacgacgauggacucgacaaucacaccauccugcuguauuacagcacagcugccucuucccuugcggucacccucaugaucgccauuuucguggucuauauggugagcagagauaacguuucuuguuccaucugccuguga

SEQ ID NO: 211290 - RNA, 1758 nt, Artificial Sequence
  derived and/or modified sequence opt5 from hemagglutinin__InfluenzaB__AHZ36961
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggggauccaaagugauuaagggcagccuuccccugaucggcgaagcugacugucuccaugagaaauaugggggacugaauaaguccaagcccuacuacacaggcgagcacgccaaagcgauugggaacugcccuaucugggucaagaccccgcugaaacucgccaauggaacaaaguauagacccccugcuaaacugcuuaaggaacgcggcuuuuucggggccaucgcuggcuuucuggagggaggcugggaagggaugauugccggauggcauggcuacacgucucacggggcccacggaguggcuguugcggccgaucucaagagcacccaggaggcuaucaacaaaauuacaaagaaucugaacucccuuagcgaacuggaggugaaaaaucuccagcggcugucuggcgccauggacgagcugcauaacgaaauccucgagcuggaugaaaaggucgacgaccuucgcgccgauaccauuuccagccaaaucgagcuggcugugcuccugucuaaugaagggaucauuaacagcgaggacgagcaccuucuggcccucgaaagaaaacugaagaagaugcugggccccuccgcggucgagaucggaaauggcuguuucgaaacaaaacauaagugcaaccagaccugccucgaucggauugcugccgggacguuugacgccggagaguucucucugccuaccuuugauagccuuaauaucacagcugccucccugaacgacgauggccucgacaaucacaccauucugcuguauuacagcacagcugccucuucccuugcggugacccucaugaucgccauuuucguuguguauauggucagccgcgauaacgugucuuguuccaucugccuguga

SEQ ID NO: 211291 - RNA, 1758 nt, Artificial Sequence; identical to SEQ ID NO: 209707
  derived and/or modified sequence opt5 from hemagglutinin__InfluenzaB__AHZ36972

SEQ ID NO: 211292 - RNA, 1758 nt, Artificial Sequence
  derived and/or modified sequence opt5 from hemagglutinin__InfluenzaB__AHZ36983
augaaggccaucauugugcugcucauggucguuaccagcaacgcugacagaaucugcacaggcauuacguccucuaauagcccccacaucgugaaaaccgccacacagggggaggugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgaccaacccucugacaauugaaguccccuacaucuguacggagggagaggaucagaucaccguguggggcuuccacagcgacaaugaaacacagauggccaaacuuuauggggauucuaagccgcagaaguuuaccuccagcgcuaacggagugacagcccacuacgucucucaaauuggcggcuucccuaaccagaccgaggacgggggacugccccaguccggcagaaucguuguggauuauauggugcaaaagagcgggaaaacgggaacaauuaccuaccagcggggcauccuccugccucagaaggucuggugcgcuucugggcgcuccaaagugauuaagggaagccuuccccugaucggcgaagccgacugucuccaugagaaauauggcgggcugaauaaguccaagcccuacuacaccggagagcacgcgaaagccaucggcaacugcccuauuuggguuaagacaccgcugaaacucgcuaaugggaccaaguauagacccccugccaaacugcuuaaggaacggggauuuuucggcgcuaucgccggguuucuggagggcggaugggaaggcaugauugccggguggcauggauacacaucucacggcgcucacgggguggcggucgccgcugaucucaagagcacgcaggaggccaucaacaaaauuaccaagaaucugaacucccuuagcgaacuggaggugaaaaaucuccagcgccugucuggagccauggacgagcugcauaacgaaauccucgagcuggaugaaaagguugacgaccuuagagcugauacaaucuccagccaaauugagcuggccgugcuccugucuaaugaaggcaucauuaacagcgaggacgagcaccuucuggcgcucgaacggaaacugaagaagaugcuggggcccuccgcugucgagaucggcaauggauguuucgaaaccaaacauaagugcaaccagacaugccucgaucgcauugccgccggcaccuuugacgcuggggaguucucucugccuacguuugauagccuuaauaucaccgccgcuucccugaacgacgauggacucgacaaucacacaauucugcuguauuacagcaccgccgcgucuucccuugccgugacacucaugaucgcuaucuucgucguguauaugguuagcagagauaacgugucuuguuccauuugccuguga

SEQ ID NO: 211293 - RNA, 1758 nt, Artificial Sequence
  derived and/or modified sequence opt5 from hemagglutinin__InfluenzaB__AHZ37005
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagagcgcucccggcggcccuuauaagaucgggacauccggaagcugccccaacgucaccaauggcaacggguucuuugccacaauggcuugggccgugccuaaaaaugacaagaacaaaaccgcgaccgauccccucacaauugaagugccguacaucuguacggaggaggaagaccagauuaccgucuggggauuccacucugauaaugagacacagauggccaagcuguauggcgacuccaagccucagaaauuuaccagcucugcuaacgggguuacaacccacuacgugucccaaaucggaggcuuccccaaucagacggaagauggcgggcuuccucagagcggaagaaucguggucgacuauauggugcagaagucuggcaaaacagggaccauuaccuaccaacggggaauccugcucccccagaagguuuggugcgccuccggccgcagcaaagugauuaaggggucccugccccuuaucggagaggcugauugucugcaugagaaauauggcggccucaacaagucuaagccuuacuacacaggggaacacgccaaagcgauuggaaacugcccgaucugggucaagacaccccugaaacuggccaauggcaccaaguauagaccucccgcuaaacuccugaaggagcggggguuuuucggagccaucgcuggcuuucuugaagggggcugggagggaaugauugccggcuggcauggguacacgagccacggagcccacggcguggcuguugcggccgaccugaaguccacccaggaagcuaucaacaaaauuacaaagaaucucaacagccugucugagcuugaggugaaaaaucugcagcgccucuccggggccauggaugaacugcauaacgagauccuggaacucgacgagaaggucgacgaucugagagccgacaccauuagcucucaaaucgaacuugcugugcugcucagcaaugagggaaucauuaacuccgaggaugaacaucugcuugcccuggagcggaaacucaagaagaugcugggcccuucugcggucgaaaucgggaauggcuguuucgagacaaaacacaagugcaaccagaccugccuggaccgcauugcugccggaacguuugaugccggcgaguucagccuccccaccuuugacucccugaauaucacagcugccagccuuaacgaugacgggcuggauaaucacaccauucuccuguauuacucuacagcugccuccagccuggcggugacccuuaugaucgccauuuucguuguguauauggucucuagagacaacguguccuguagcaucugccucuga

SEQ ID NO: 211294 - RNA, 1758 nt, Artificial Sequence; identical to SEQ ID NO: 209669
  derived and/or modified sequence opt5 from hemagglutinin__InfluenzaB__AHZ37016

SEQ ID NO: 211295 - RNA, 1758 nt, Artificial Sequence
  derived and/or modified sequence opt5 from hemagglutinin__InfluenzaB__AHZ37027
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcaucauccacgaggugcggccuguuacauccggguguuuucccauuaugcaugaucgcaccaaaaucagacaacugccuaaucuccugcggggauacgaacacauucgccugucuacgcauaacgugaucaaugccgagaacgcuccgggcggccccuauaagauugggacaagcggauccugccucaaugucaccaacggcaauggguucuuugccacaauggcuugggccgugccuaaaaacgacaagaauaaaaccgcgaccaacccccugacaaucgaagugccuuacauuuguacggagggagaggaucagaucaccgucuggggcuuccacagcgacaaugaaacacagauggccaaacuuuauggggauucuaagccccagaaguuuaccuccagcgcuaacggaguuacaacccacuacgugucucaaaucggcggcuucccgaaccagacggaggacgggggacugccucaguccggcagaauuguggucgauuauauggugcaaaagagcgggaaaacaggaaccaucaccuaccagcggggcauucuccugccccagaagguuuggugcgccucugggcgcuccaaagugaucaagggaagccuuccucugauuggcgaagcugacugucuccaugagaaauauggcgggcugaauaaguccaagcccuacuacacaggagagcacgccaaagcgaucggcaacugccccaucugggucaagaccccucugaaacucgccaaugggacaaaguauagaccgcccgcuaaacugcuuaaggaacggggauuuuucggcgccauugcuggguuucuggagggcggaugggaaggcaugaucgccggguggcauggauacacgucucacggcgcccacgggguggcuguugcggccgaucucaagagcacccaggaggcuauuaacaaaaucacaaagaaucugaacucccuuagcgaacuggaggugaaaaaucuccagcgccugucuggagccauggacgagcugcauaacgaaauucucgagcuggaugaaaaggucgacgaccuuagagccgauaccaucuccagccaaaucgagcuggcugugcuccugucuaaugaaggcauuaucaacagcgaggacgagcaccuucuggcccucgaacggaaacugaagaagaugcuggggccuuccgcggucgagauuggcaauggauguuucgaaacaaaacauaagugcaaccagaccugccucgaucgcaucgcugccggcacguuugacgccggggaguucucucugcccaccuuugauagccuuaauauuacagcugccucccugaacgacgauggacucgacaaucacaccauccugcuguauuacagcacagcugccucuucccuugcggugacccucaugauugccaucuucguuguguauauggucagcagagauaacgugucuuguuccaucugccuguga

SEQ ID NO: 211296 - RNA, 1758 nt, Artificial Sequence; identical to SEQ ID NO: 209669
  derived and/or modified sequence opt5 from hemagglutinin__InfluenzaB__AHZ37038

SEQ ID NO: 211297 - RNA, 1758 nt, Artificial Sequence; identical to SEQ ID NO: 211183
  derived and/or modified sequence opt5 from hemagglutinin__InfluenzaB__AHZ37049

SEQ ID NO: 211298 - RNA, 1758 nt, Artificial Sequence; identical to SEQ ID NO: 211183
  derived and/or modified sequence opt5 from hemagglutinin__InfluenzaB__AHZ37060

SEQ ID NO: 211299 - RNA, 1758 nt, Artificial Sequence; identical to SEQ ID NO: 209669
  derived and/or modified sequence opt5 from hemagglutinin__InfluenzaB__AHZ37071

SEQ ID NO: 211300 - RNA, 1758 nt, Artificial Sequence; identical to SEQ ID NO: 209669
  derived and/or modified sequence opt5 from hemagglutinin__InfluenzaB__AHZ37082

SEQ ID NO: 211301 - RNA, 1758 nt, Artificial Sequence; identical to SEQ ID NO: 211183
  derived and/or modified sequence opt5 from hemagglutinin__InfluenzaB__AHZ37093

SEQ ID NO: 211302 - RNA, 1758 nt, Artificial Sequence
  derived and/or modified sequence opt5 from hemagglutinin__InfluenzaB__AHZ37104
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgaucauauggugcaaaagagcgggaaaacaggaaccauuaccuaucagcggggcauccuccugccucagaagguuuggugcgccucugggcgcuccaaagugauuaagggaagccuuccccugaucggcgaagcugacugucuccacgagaaauacggcgggcugaauaaguccaagcccuauuacacaggagagcaugccaaagcgauuggcaacugcccuaucugggucaagaccccgcugaaacucgccaaugggacaaaguacagacccccugcuaaacugcuuaaggaacggggauuuuucggcgccaucgcuggguuucuggagggcggaugggaaggcaugauugccggguggcacggauauacgucucacggcgcccaugggguggcuguugcggccgaucucaagagcacccaggaggcuaucaacaaaauuacaaagaaucugaacucccuuagcgaacuggaggugaaaaaucuccagcgccugucuggagccauggacgagcugcacaacgaaauccucgagcuggaugaaaaggucgacgaccuuagagccgauaccauuuccagccaaaucgagcuggcugugcuccugucuaaugaaggcaucauuaacagcgaggacgagcaucuucuggcccucgaacggaaacugaagaagaugcuggggcccuccgcggucgagaucggcaauggauguuucgaaacaaaacacaagugcaaccagaccugccucgaucgcauugcugccggcacguuugacgccggggaguucucucugccuaccuuugauagccuuaauaucacagcugccucccugaacgacgauggacucgacaaucauaccauucugcuguacuauagcacagcugccucuucccuugcggugacccucaugaucgccauuuucguuguguacauggucagcagagauaacgugucuuguuccaucugccuguga

SEQ ID NO: 211303 - RNA, 1758 nt, Artificial Sequence
  derived and/or modified sequence opt5 from hemagglutinin__InfluenzaB__AHZ41770
augaaggccaucauugugcugcucauggucguuaccagcaacgcugacagaaucugcacaggcauuacguccucuaauagcccccacaucgugaaaaccgccacacagggggaagugaacgucaccggagugauuccucugacaaccacaccgaccaagucccauuucgcgaaucuuaaaggcacggaaacccgggggaagcugugucccaaaugccucaacuguacagaucuggacguugcucuuggacgcccuaagugcaccggcaagauccccucugccagagugagcauccugcacgagguccggccugugacauccggguguuuucccauuaugcaugaucgcaccaaaaucagacaacucccuaaucugcugcggggauacgaacacauucgccucucuacgcauaacguuaucaaugccgagaacgcuccgggcggccccuauaagauugggacaagcggauccugcccuaauaucaccaacggcaauggguucuuugccacaauggcuugggccgugcccaaaaacgacaagaauaaaaccgcgauuaacccucugaccaucgaaguccccuacaucuguacagagggagaggaucagauuacgguguggggcuuccacagcgacaaugaaacccagauggccaagcuguauggggauucugagccgcagaaguuuacauccagcgcuaacggagugaccacacacuacgucucucaaaucggcggcuucccuaaccagaccgaagacgggggacuuccccaguccggcagaauuguuguggauuauauggugcagaaaagcgggaagacgggaacaaucaccuaccaacggggcauucuccugccucagaaagucuggugcgccucugggcgcuccaaggugaucaaaggaagccuuccccugaucggcgaggcugacugucuccaugagaaguauggcgggcugaauaaauccaagcccuacuacaccggagaacacgccaaggcgauuggcaacugcccuaucuggguuaaaacaccgcugaagcucgccaaugggaccaaauauagacccccugcuaagcugcuuaaagagcggggauuuuucggcgccauugcuggguuucuggaaggcggaugggagggcaugaucgccggguggcauggauacacaucucacggcgcccacgggguggcugucgcggccgaucucaagagcacgcaggaagcuauuaacaagaucaccaaaaaucugaacucccuuagcgagcuggaggugaagaaucuccagcgccugucuggagccauggacgaacugcauaacgagauccucgaacuggaugagaaaguugacgaccuuagagccgauacaauuuccagccaaaucgaacuggcugugcuccugucuaaugagggcauuaucaacagcgaggacgaacaccuucuggcccucgagcggaagcugaaaaagaugcuggggcccuccgcggucgaaauuggcaauggauguuucgagaccaagcauaaaugcaaccagacaugccucgaucgcaucgcugccggcaccuuugacgccggggaguucucucugccuacguuugauagccuuaauauuaccgcugccucccugaacgacgauggacucgacaaucacacaauccugcuguauuacagcaccgcugccucuucccuugcggugacacucaugaucgccauuuucgucguguauaugguuagcagagauaacgugucuuguuccaucugccuguga

SEQ ID NO: 211304 - RNA, 1758 nt, Artificial Sequence; identical to SEQ ID NO: 209707
  derived and/or modified sequence opt5 from hemagglutinin__InfluenzaB__AHZ41781

SEQ ID NO: 211305 - RNA, 1758 nt, Artificial Sequence; identical to SEQ ID NO: 209707
  derived and/or modified sequence opt5 from hemagglutinin__InfluenzaB__AHZ41792

SEQ ID NO: 211306 - RNA, 1758 nt, Artificial Sequence; identical to SEQ ID NO: 209707
  derived and/or modified sequence opt5 from hemagglutinin__InfluenzaB__AHZ41803

SEQ ID NO: 211307 - RNA, 1758 nt, Artificial Sequence
  derived and/or modified sequence opt5 from hemagglutinin__InfluenzaB__AHZ41814
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaagccucagaaauuuaccuccagcgcuaacggaguuacaacccacuacgugucucaaaucggcggcuuccccaaccagacggaggacgggggacuuccucaguccggcagaaucguggucgauuauauggugcaaaagagcgggaaaacaggaaccguuaccuaccagcggggcauucugcucccccagaagguguggugcgccucugggcgcuccaaagucaucaagggaagccugccccuuauuggcgaagcugacugucugcaugagaaauauggcgggcucaauaaguccaagccuuacuacacaggagagcacgccaaagcgaucggcaacugcccgauuugggugaagacaccccugaaacuggccaaugggaccaaguauagaccucccgcuaaacuccugaaggaacggggauuuuucggcgccaucgcuggguuucuugagggcggaugggaaggcaugaucgccggguggcauggauacacgucucacggcgcccacgggguugcuguggcggccgaucucaagagcacccaggaggcuauuaacaaaaucacaaagaaucugaacucccugagcgaacuugaggucaaaaaucugcagcgccucucuggagccauggacgagcugcauaacgaaauucuggagcucgaugaaaagguggacgaccugagagccgauaccaucuccagccaaauugagcuugcuguccugcucucuaaugaaggcaucaucaacagcgaggacgagcaucugcuugcccuggaacggaaacucaagaagaugcuggggccuuccgcgguggagauuggcaauggauguuucgaaacaaaacacaagugcaaccagaccugccuggaucgcaucgcugccggcacguuugacgccggggaguucucucuccccaccuuugauagccugaauauuacagcugccucccuuaacgacgauggacuggacaaucacaccauccuccuguauuacagcacagcugccucuucccuggcgguuacccuuaugauugccaucuucguggucuauauggugagcagagauaacguuucuuguuccauuugccucuga

SEQ ID NO: 211308 - RNA, 1758 nt, Artificial Sequence; identical to SEQ ID NO: 209707
  derived and/or modified sequence opt5 from hemagglutinin__InfluenzaB__AHZ41825

SEQ ID NO: 211309 - RNA, 1758 nt, Artificial Sequence; identical to SEQ ID NO: 209707
  derived and/or modified sequence opt5 from hemagglutinin__InfluenzaB__AHZ41836

SEQ ID NO: 211310 - RNA, 1758 nt, Artificial Sequence; identical to SEQ ID NO: 209707
  derived and/or modified sequence opt5 from hemagglutinin__InfluenzaB__AHZ41847

SEQ ID NO: 211311 - RNA, 1755 nt, Artificial Sequence; identical to SEQ ID NO: 211155
  derived and/or modified sequence opt5 from hemagglutinin__InfluenzaB__AHZ41858

SEQ ID NO: 211312 - RNA, 1758 nt, Artificial Sequence; identical to SEQ ID NO: 211180
  derived and/or modified sequence opt5 from hemagglutinin__InfluenzaB__AHZ41869

SEQ ID NO: 211313 - RNA, 1755 nt, Artificial Sequence
  derived and/or modified sequence opt5 from hemagglutinin__InfluenzaB__AIC73844
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacaaaugcaaccaaacaugccucgacagaaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccguuacacucaugcuggcuauuuucaucguguauauggucucucgggacaauguguccuguagcauuugccuguga

SEQ ID NO: 211314 - RNA, 1758 nt, Artificial Sequence; identical to SEQ ID NO: 210889
  derived and/or modified sequence opt5 from hemagglutinin__InfluenzaB__AIC73845

SEQ ID NO: 211315 - RNA, 1758 nt, Artificial Sequence; identical to SEQ ID NO: 210889
  derived and/or modified sequence opt5 from hemagglutinin__InfluenzaB__AIC73846

SEQ ID NO: 211316 - RNA, 1758 nt, Artificial Sequence
  derived and/or modified sequence opt5 from hemagglutinin__InfluenzaB__AIC73847
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucgauuguacagaccuggauguggcucuuggacgcccuaagugcaccggcaagauucccucugccagagucagcauccugcacgaggugcggccuguuacauccggguguuuucccaucaugcaugaccgcaccaaaauuagacaacucccuaaccugcugcggggauacgaacacauccgccucucuacgcauaaugugauuaacgccgaggaugcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaucagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaacaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggacgaaaaggucgaugaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgaucgcauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagcagagauaacgugucuuguuccaucugccuguga

SEQ ID NO: 211317 - RNA, 1758 nt, Artificial Sequence; identical to SEQ ID NO: 210889
  derived and/or modified sequence opt5 from hemagglutinin__InfluenzaB__AIC73848

SEQ ID NO: 211318 - RNA, 1755 nt, Artificial Sequence; identical to SEQ ID NO: 211153
  derived and/or modified sequence opt5 from hemagglutinin__InfluenzaB__AIC73849

SEQ ID NO: 211319 - RNA, 1758 nt, Artificial Sequence
  derived and/or modified sequence opt5 from hemagglutinin__InfluenzaB__AIC73850
augaaggccaucauugugcugcucauggucgcuaccagcaacgccgacagaaucugcacaggcauuacguccucuaauagcccccacguugugaaaaccgcgacacagggggaggugaacgucaccggagugaucccucugacaaccacaccgaccaagucccauuucgcuaaucuuaaaggcacggaaacccgggggaagcugugucccaaaugccucaacuguacagaucuggacguugcccuuggacgcccuaagugcaccggcaagauucccucugccagagugagcauccugcacgagguccggccugugacauccggguguuuucccaucaugcaugaucgcaccaaaauuagacaacucccuaaucugcugcggggauacgaacacauccgccucucuacgcauaacguuauuaaugcugaggacgccccgggcggccccuauaagaucgggacaagcggauccugcccuaacgugaccaauggcaacggguucuuugcuacaauggccugggcgguccccaaaaaugauaagaacaaaaccgccaccaauccucugacaauugaagugcccuacaucuguacggagggagaggaccagauuaccguguggggcuuccacagcgauaacgaaacacagauggcuaagcuguauggggacucuaagccgcagaaauuuaccuccagcgccaauggagucacaacccacuacguuucucaaaucggcggcuucccuaaccagacggaggaugggggacugccccaguccggcagaaucgugguggacuauaugguccaaaagagcgggaaaacaggaaccauuaccuaccagcggggcauccuccugccucagaagguguggugcgcuucugggcgcuccaaaguuauuaagggaagccuuccccugaucggcgaagccgauugucuccaugagaaauauggcgggcugaacaaguccaagcccuacuacacaggagagcacgcgaaagccauuggcaauugcccuaucugggugaagaccccgcugaaacucgcuaacgggacaaaguauagacccccugccaaacugcuuaaggaacggggauuuuucggcgcuaucgccggguuucuggagggcggaugggaaggcaugauugccggguggcauggauacacgucucacggcgcucacggggucgcgguggccgcugaccucaagagcacccaggaggccaucaauaaaauuacaaagaaccuuaauucccuuagcgaacuggagguuaaaaaccuccagcgccugucuggagccauggaugagcugcauaaugaaauccucgagcuggacgaaaagguggacgaucuuagagcugacaccauuuccagccaaaucgagcuggccguccuccugucuaacgaaggcaucauuaauagcgaggaugagcaccuucuggcgcucgaacggaaacugaagaagaugcuggggcccuccgcuguggagaucggcaacggauguuucgaaacaaaacauaagugcaaucagaccugccucgaccgcauugccgccggcacguuugaugcuggggaguucucucugccuaccuuugacagccuuaacaucacagccgcuucccugaaugaugacggacucgauaaccacaccauucugcuguauuacagcacagccgcgucuucccuugccgucacccucaugaucgcuauuuucgugguuuauauggugagcagagacaaugucucuuguuccaucugccuguga

SEQ ID NO: 211320 - RNA, 1758 nt, Artificial Sequence; identical to SEQ ID NO: 209911
  derived and/or modified sequence opt5 from hemagglutinin__InfluenzaB__AIC73851

SEQ ID NO: 211321 - RNA, 1755 nt, Artificial Sequence; identical to SEQ ID NO: 211313
  derived and/or modified sequence opt5 from hemagglutinin__InfluenzaB__AIC73852

SEQ ID NO: 211322 - RNA, 1755 nt, Artificial Sequence; identical to SEQ ID NO: 211313
  derived and/or modified sequence opt5 from hemagglutinin__InfluenzaB__AIC73853

SEQ ID NO: 211323 - RNA, 1758 nt, Artificial Sequence
  derived and/or modified sequence opt5 from hemagglutinin__InfluenzaB__AIC73855
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaucauugggacaagcggauccugcccuaaugucaccaacggcaauggguucuuugccacaauggcuugggccgugcccaagaacgacaaaaauaagaccgcgaccaacccucugacaaucgaagugcccuacauuuguacggagggagaggaucagaucaccgucuggggcuuccacagcgacaaugaaacacagauggccaaacuuuauggggauucuaacccgcagaaguuuaccuccagcgcuaacggaguuacaacccacuacgugucucaaaucggcggcuucccuaaucagacggaggacgggggacugccccaguccggcagaauuguggucgauuauauggugcagaaguccgggaaaacaggaaccaucaccuaccaacggggcauucuccugccucagaagguuuggugcgccucugggcgcuccaaagugaucaagggaagccuuccccugauuggcgaagcugacugucuccaugagaaauauggcgggcugaacaaguccaaacccuacuacacaggagagcacgccaaggcgaucggcaauugcccuaucugggucaagaccccgcugaaacucgccaacgggacaaaguauagacccccugcuaaacugcuuaaggaacggggauuuuucggcgccauugcuggguuucuggagggcggaugggaaggcaugaucgccggguggcauggauacacgucucacggcgcccacgggguggcuguugcggccgaucucaaaagcacccaggaggcuauuaauaagaucacaaagaaccugaauagccuuagcgaacuggaggugaaaaaccuccagcgccugucuggagccauggacgagcugcauaaugaaauucucgagcuggaugaaaaggucgacgaccuuagagccgauaccaucuccagccaaaucgagcuggcugugcuccugucuaacgaaggcauuaucaauagcgaggacgagcaccuucuggcccucgaacggaaacugaagaaaaugcuggggcccuccgcggucgagauuggcaacggauguuucgaaacaaagcauaagugcaaucagaccugccucgaucgcaucgcugccggcacguuugacgccggggaguucucucugccuaccuuugauagccuuaacauuacagcugccucccugaaugacgauggacucgacaaccacaccauccugcuguauuacagcacagcugccucuucccuugcggugacccucaugauugccaucuucguuguguauauggucagcagagauaacgugucuuguuccaucugccuguga

SEQ ID NO: 211324 - RNA, 1758 nt, Artificial Sequence; identical to SEQ ID NO: 210889
  derived and/or modified sequence opt5 from hemagglutinin__InfluenzaB__AIC73856

SEQ ID NO: 211325 - RNA, 1758 nt, Artificial Sequence; identical to SEQ ID NO: 210889
  derived and/or modified sequence opt5 from hemagglutinin__InfluenzaB__AIC73857

SEQ ID NO: 211326 - RNA, 1758 nt, Artificial Sequence; identical to SEQ ID NO: 210889
  derived and/or modified sequence opt5 from hemagglutinin__InfluenzaB__AIC73859

SEQ ID NO: 211327 - RNA, 1758 nt, Artificial Sequence
  derived and/or modified sequence opt5 from hemagglutinin__InfluenzaB__AIC73860
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaacccgcagaaguuuaccuccagcgcuaacggaguuacaacccacuacgugucucaaaucggcggcuucccuaaucagacggaggacgggggacugccccaguccggcagaaucguggucgauuauauggugcagaaaagcgggaagacaggaaccauuaccuaccaacggggcauccuccugccucagaaaguuuggugcgccucugggcgcuccaaggugauuaaaggaagccuuccccugaucggcgaagcugacugucuccaugagaaguauggcgggcugaacaaauccaagcccuacuacacaggagagcacgccaaggcgauuggcaauugcccuaucugggucaaaaccccgcugaagcucgccaacgggacaaaauauagacccccugcuaagcugcuuaaagaacggggauuuuucggcgccaucgcuggguuucuggagggcggaugggaaggcaugauugccggguggcauggauacacgucucacggcgcccacgggguggcuguugcggccgaucucaagagcacccaggaggcuaucaauaagauuacaaagaaccuuaauucccugagcgaacuggaggugaagaaccuccagcgccugucuggagccauggacgagcugcauaaugaaauccucgagcuggaugaaaaagucgacgaccuuagagccgauaccauguccagccaaauugagcuggcugugcuccugucuaacgaaggcaucaucaauagcgaggacgagcaccuucuggcccucgaacggaagcugaaaaagaugcuggggcccuccgcggucgagauuggcaacggauguuucgaaacaaagcauaaaugcaaucagaccugccucgaucgcaucgcugccggcacguuugacgccggggaguucucucugccuaccuuugauagccuuaacauuacagcugccucccugaaugacgauggacucgacaaccacaccauccugcuguauuacagcacagcugccucuucccuugcggugacccucaugauugccaucuucguuguguauauggucagcagagauaacgugucuuguuccauuugccuguga

SEQ ID NO: 211328 - RNA, 1758 nt, Artificial Sequence
  derived and/or modified sequence opt5 from hemagglutinin__InfluenzaB__AIC73861
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaauacagagaacgccccgggcggccccuauaagaucgggaccagcggauccugcccuaaugucacaaacggcaauggguucuuugcuaccauggccugggcugugcccaaaaacgacaagaauaaaaccgccacaaacccucugacgauugaagugcccuacaucuguaccgagggagaggaucagauuacagucuggggcuuccacagcgacaaugaaacccagauggcgaaacuuuauggggauucuaacccgcagaaguuuacauccagcgccaacggaguuaccauccacuacgugucucaaaucggcggcuucccuaaucagacggaggacgggggacugccccaguccggcagaauuguggucgauuauauggugcagaaaagcgggaagacaggaaccaucaccuaccaacggggcauucuccugccucagaaaguuuggugcgcuucugggcgcuccaaggugaucaaaggaagccuuccccugauuggcgaagccgacugucuccaugagaaguauggcgggcugaacaaauccaagcccuacuacacaggagagcacgcuaaggccaucggcaauugcccuaucugggucaaaaccccgcugaagcucgcgaacgggacaaaauauagacccccugccaagcugcuuaaagaacggggauuuuucggcgcuauugccggguuucuggagggcggaugggaaggcaugaucgcuggguggcauggauacacgucucacggcgcccacgggguggccguugcugcggaucucaagagcacccaggaggccauuaauaagaucacaaagaaccuuaauucccugagcgaacuggaggugaagaaccuccagcgccugucuggagcuauggacgagcugcauaaugaaauucucgagcuggaugaaaaagucgacgaccuuagagccgauaccaucuccagccaaaucgagcuggccgugcuccugucuaacgaaggcauuaucaauagcgaggacgagcaccuucuggcucucgaacggaagcugaaaaagaugcuggggcccuccgccgucgagauuggcaacggauguuucgaaacaaagcauaaaugcaaucagaccugccucgaucgcaucgcggcuggcacguuugacgccggggaguucucucugccuaccuuugauagccuuaacauuacagccgcuucccugaaugacgauggacucgacaaccacaccauccugcuguauuacagcacagccgcuucuucccuugccgugacccucaugauugcgaucuucguuguguauauggucagcagagauaacgugucuuguuccaucugccuguga

SEQ ID NO: 211329 - RNA, 1758 nt, Artificial Sequence; identical to SEQ ID NO: 211327
  derived and/or modified sequence opt5 from hemagglutinin__InfluenzaB__AIC73862

SEQ ID NO: 211330 - RNA, 1758 nt, Artificial Sequence; identical to SEQ ID NO: 211327
  derived and/or modified sequence opt5 from hemagglutinin__InfluenzaB__AIC73863

SEQ ID NO: 211331 - RNA, 1758 nt, Artificial Sequence; identical to SEQ ID NO: 211327
  derived and/or modified sequence opt5 from hemagglutinin__InfluenzaB__AIC73864

SEQ ID NO: 211332 - RNA, 1755 nt, Artificial Sequence
  derived and/or modified sequence opt5 from hemagglutinin__InfluenzaB__AIC73865
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagagagaggauggcgggcucccucagucuggacggaucguggucgacuacaugaugcaaaaacccggcaagaccgggacgauuguguaucagcgcggaguucugcuuccucagaaaguguggugcgcguccggcagaagcaaggucaucaaagggucccugccccucaucggagaagccgauugucugcaugagaaguacggcggccugaacaaaucuaagcccuacuauacaggggaacacgcuaaggccauuggaaauugcccuaucugggugaaaaccccgcucaagcuggcuaacggcaccaaauaccggcccccugccaaacuucugaaagagcgcggguuuuucggagccauugcuggcuuucucgaagggggcugggaaggaaugaucgcgggcuggcacggguauacaagccauggagcccacggcguugcuguggccgccgaccugaaguccacccaggaggcuauuaauaagaucacaaagaaccuuaauagccugucugaacucgaggucaagaaccugcaaagacuguccggggccauggacgaacuccauaaugagauccuggagcuugaugaaaaaguggacgaucugcgggcggacacgauuagcucucagaucgagcucgcuguccugcuuagcaacgaaggaauuaucaauuccgaggaugaacaucugcucgcccuggagcgcaagcugaaaaagaugcucggccccucugccguggacauugggaacggcuguuucgagaccaagcacaaaugcaaucagacaugccuggauagaaucgcugccggaaccuuuaacgcuggcgaguucagccuuccuacauuugacucccugaauaucaccgccgcgagccucaacgaugacgggcuggauaaucacacgauucugcuuuacuauucuaccgccgcuuccagccucgccguuacacugaugcuggcuaucuucauuguguacauggucucucgggacaacguguccuguagcaucugccucuga

SEQ ID NO: 211333 - RNA, 1758 nt, Artificial Sequence
  derived and/or modified sequence opt5 from hemagglutinin__InfluenzaB__AIC73867
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauugacgccgagaaugcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaaacuuuauggggacucuaauccgcagaaguuuaccuccagcgcuaacggaguuacaacccacuacgugucucaaaucggcggcuucccuaaccagacggaggaugggggacugccccaguccggcagaaucguggucgacuauauggugcagaaaagcgggaagacaggaaccauuaccuaccaacggggcauccuccugccucagaaaguuuggugcgccucugggcgcuccaaggugauuaaaggaagccuuccccugaucggcgaagcugauugucuccaugagaaguauggcgggcugaauaaauccaagcccuacuacacaggagagcacgccaaggcgauuggcaacugcccuaucugggucaaaaccccgcugaagcucgccaaugggacaaaauauagacccccugcuaagcugcuuaaagaacggggauuuuucggcgccaucgcuggguuucuggagggcggaugggaaggcaugauugccggguggcauggauacacgucucacggcgcccacgggguggcuguugcggccgaccucaagagcacccaggaggcuaucaacaagauuacaaagaaucugaacucccuuagcgaacuggaggugaagaaucuccagcgccugucuggagccauggaugagcugcauaacgaaauccucgagcuggacgaaaaagucgacgaucuuagagccgacaccauuuccagccaaaucgagcuggcugugcuccugucuaaugaaggcaucauuaacagcgaggaugagcaccuucuggcccucgaacggaagcugaaaaagaugcuggggcccuccgcggucgagaucggcaauggauguuucgaaacaaagcauaaaugcaaccagaccugccucgaccgcauugcugccggcacguuugaugccggggaguucucucugccuaccuuugacagccuuaauaucacagcugccucccugaacgaugacggacucgauaaucacaccauucugcuguauuacagcacagcugccucuucccuugcggugacccucaugaucgccauuuucguuguguauauggucagcagagacaacgugucuuguuccaucugccuguga

SEQ ID NO: 211334 - RNA, 1758 nt, Artificial Sequence; identical to SEQ ID NO: 209911
  derived and/or modified sequence opt5 from hemagglutinin__InfluenzaB__AIC73868

SEQ ID NO: 211335 - RNA, 1758 nt, Artificial Sequence; identical to SEQ ID NO: 211327
  derived and/or modified sequence opt5 from hemagglutinin__InfluenzaB__AIC73869

SEQ ID NO: 211336 - RNA, 1758 nt, Artificial Sequence; identical to SEQ ID NO: 211327
  derived and/or modified sequence opt5 from hemagglutinin__InfluenzaB__AIC73870

SEQ ID NO: 211337 - RNA, 1758 nt, Artificial Sequence; identical to SEQ ID NO: 210889
  derived and/or modified sequence opt5 from hemagglutinin__InfluenzaB__AIC73871

SEQ ID NO: 211338 - RNA, 1755 nt, Artificial Sequence; identical to SEQ ID NO: 211313
  derived and/or modified sequence opt5 from hemagglutinin__InfluenzaB__AIC73872

SEQ ID NO: 211339 - RNA, 1755 nt, Artificial Sequence; identical to SEQ ID NO: 211153
  derived and/or modified sequence opt5 from hemagglutinin__InfluenzaB__AIC73873

SEQ ID NO: 211340 - RNA, 1755 nt, Artificial Sequence; identical to SEQ ID NO: 211313
  derived and/or modified sequence opt5 from hemagglutinin__InfluenzaB__AIC73874

SEQ ID NO: 211341 - RNA, 1755 nt, Artificial Sequence; identical to SEQ ID NO: 211332
  derived and/or modified sequence opt5 from hemagglutinin__InfluenzaB__AIC73875

SEQ ID NO: 211342 - RNA, 1755 nt, Artificial Sequence
  derived and/or modified sequence opt5 from hemagglutinin__InfluenzaB__AIC73876
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuugugcugaaggggaggaucagaucacggucuggggauuccauuccgacaauaaaacccagaugaagaaccuguacggcgauagcaauccccaaaaguuuacaucuuccgccaacgggguuaccacacacuaugugagccagauuggaggcuucccggaccagagagaggauggcgggcucccucagucuggacggaucguggucgacuacaugaugcaaaaacccggcaagaccgggacgauuguguaucagcgcggaguucugcuuccucagaaaguguggugcgcguccggcagaagcaaggucaucaaagggucccugccccucaucggagaagccgauugucugcaugagaaguacggcggccugaacaaaucuaagcccuacuauacaggggaacacgcuaaggccauuggaaauugcccuaucugggugaaaaccccgcucaagcuggcuaacggcaccaaauaccggcccccugccaaacuucugaaagagcgcggguuuuucggagccauugcuggcuuucucgaagggggcugggaaggaaugaucgcgggcuggcacggguauacaagccauggagcccacggcguugcuguggccgccgaccugaaguccacccaggaggcuauuaauaagaucacaaagaaccuuaauagccugucugaacucgaggucaagaaccugcaaagacuguccggggccauggacgaacuccauaaugagauccuggagcuugaugaaaaaguggacgaucugcgggcggacacgauuagcucucagaucgagcucgcuguccugcuuagcaacgaaggaauuaucaauuccgaggaugaacaucugcucgcccuggagcgcaagcugaaaaagaugcucggccccucugccguggacauugggaacggcuguuucgagaccaagcacaaaugcaaucagacaugccugaacagaaucgcugccggaaccuuuaaugcuggcgaguucagccuuccuacauuugauucccugaacaucaccgccgcgagccucaaugacgaugggcuggacaaccacacgauucugcuuuacuauucuaccgccgcuuccagccucgccguuacacugaugcuggcuaucuucauuguguacauggucucucgggauaacguguccuguagcaucugccucuga

SEQ ID NO: 211343 - RNA, 1755 nt, Artificial Sequence; identical to SEQ ID NO: 211332
  derived and/or modified sequence opt5 from hemagglutinin__InfluenzaB__AIC73877

SEQ ID NO: 211344 - RNA, 1755 nt, Artificial Sequence; identical to SEQ ID NO: 211332
  derived and/or modified sequence opt5 from hemagglutinin__InfluenzaB__AIC73878

SEQ ID NO: 211345 - RNA, 1755 nt, Artificial Sequence; identical to SEQ ID NO: 211332
  derived and/or modified sequence opt5 from hemagglutinin__InfluenzaB__AIC73879

SEQ ID NO: 211346 - RNA, 1755 nt, Artificial Sequence; identical to SEQ ID NO: 211332
  derived and/or modified sequence opt5 from hemagglutinin__InfluenzaB__AIC73880

SEQ ID NO: 211347 - RNA, 1755 nt, Artificial Sequence; identical to SEQ ID NO: 211332
  derived and/or modified sequence opt5 from hemagglutinin__InfluenzaB__AIC73881

SEQ ID NO: 211348 - RNA, 1755 nt, Artificial Sequence; identical to SEQ ID NO: 211332
  derived and/or modified sequence opt5 from hemagglutinin__InfluenzaB__AIC73882

SEQ ID NO: 211349 - RNA, 1755 nt, Artificial Sequence; identical to SEQ ID NO: 211153
  derived and/or modified sequence opt5 from hemagglutinin__InfluenzaB__AIC73883

SEQ ID NO: 211350 - RNA, 1755 nt, Artificial Sequence; identical to SEQ ID NO: 211332
  derived and/or modified sequence opt5 from hemagglutinin__InfluenzaB__AIC73884

SEQ ID NO: 211351 - RNA, 1758 nt, Artificial Sequence
  derived and/or modified sequence opt5 from hemagglutinin__InfluenzaB__AIC73885
auggaagccaucauugugcugcucauggucguuaccagcaacgcugacagaaucugcacaggcauuacguccucuaauagcccccacguggugaagaccgccacacagggggaagucaacgugaccggaguuaucccucugacaaccacaccgaccaaaucccauuucgcgaaucuuaagggcacggagacccgggggaaacugugucccaagugccucaacuguacagaucuggacguggcucuuggacgcccuaaaugcaccggcaagauucccucugccagagucagcauccugcacgaagugcggccuguuacauccggguguuuucccaucaugcaugaucgcaccaagauuagacaacucccuaaucugcugcggggauacgagcacauccgccucucuacgcauaacgugauuaaugccgaagacgcuccgggcggccccuauaaaaucgggacaagcggauccugcccuaacgucaccaauggcaacggguucuuugccacaauggcuugggccgugcccaagaaugauaaaaacaagaccgcgaccaauccucugacaauugaggugcccuacaucuguacggagggagaagaccagauuaccgucuggggcuuccacagcgauaacgagacacagauggccaaacuuuauggggacucuaagccgcagaaguuuaccuccagcgcuaauggaguuacaacccacuacgugucucaaaucggcggcuucccuaaccagacggaagaugggggacugccccaguccggcagaaucguggucgacuauauggugcagaaaagcgggaagacaggaaccauuaccuaccaacggggcauccuccugccucagaaaguuuggugcgccucugggcgcuccaaggugauuaaaggaagccuuccccugaucggcgaggcugauugucuccaugagaaguauggcgggcugaacaaauccaagcccuacuacacaggagaacacgccaaggcgauuggcaauugcccuaucugggucaaaaccccgcugaagcucgccaacgggacaaaauauagacccccugcuaagcugcuuaaagagcggggauuuuucggcgccaucgcuggguuucuggaaggcggaugggagggcaugauugccggguggcauggauacacgucucacggcgcccacgggguggcuguugcggccgaccucaagagcacccaggaagcuaucaauaagauuaccaaaaaccuuaauucccugagcgagcuggaggugaagaaccuccagcgccugucuggagccauggaugaacugcauaaugagauccucgaacuggacgagaaagucgacgaucuuagagccgacacaauuuccagccaaaucgaacuggcugugcuccugucuaacgagggcaucauuaauagcgaggaugaacaccuucuggcccucgagcggaagcugaaaaagaugcuggggcccuccgcggucgaaaucggcaacggauguuucgagacaaagcauaaaugcaaucagaccugccucgaccgcauugcugccggcacguuugaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagcagagacaaugugucuuguuccaucugccuguga

SEQ ID NO: 211352 - RNA, 1758 nt, Artificial Sequence; identical to SEQ ID NO: 210889
  derived and/or modified sequence opt5 from hemagglutinin__InfluenzaB__AIC73886

SEQ ID NO: 211353 - RNA, 1758 nt, Artificial Sequence; identical to SEQ ID NO: 211333
  derived and/or modified sequence opt5 from hemagglutinin__InfluenzaB__AIC73887

SEQ ID NO: 211354 - RNA, 1755 nt, Artificial Sequence; identical to SEQ ID NO: 211153
  derived and/or modified sequence opt5 from hemagglutinin__InfluenzaB__AIC73888

SEQ ID NO: 211355 - RNA, 1755 nt, Artificial Sequence; identical to SEQ ID NO: 211313
  derived and/or modified sequence opt5 from hemagglutinin__InfluenzaB__AIC73889

SEQ ID NO: 211356 - RNA, 1755 nt, Artificial Sequence; identical to SEQ ID NO: 211313
  derived and/or modified sequence opt5 from hemagglutinin__InfluenzaB__AIC73890

SEQ ID NO: 211357 - RNA, 1758 nt, Artificial Sequence
  derived and/or modified sequence opt5 from hemagglutinin__InfluenzaB__AIC73892
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaaacuuuauggggacucuaagccgcagaaguuuaccuccagcgcuaauggaguuacaacccacuacgugucucaaaucggcggcuucccuaaccagacggaggaugggggacugccccaguccggcagaaucguggucgacuauauggugcaaaagagcgggaaaacaggaaccauuaccuaccagcggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucaagaccucucugaaacucgccaacgggacaaaguauagaccgcccgcuaaacugcuuaaggaacggggauuuuucggcgccaucgcuggguuucuggagggcggaugggaaggcaugauugccggguggcauggauacacgagccacggcgcccacgggguggcuguugcggccgaccucaaguccacccaggaggcuaucaauaaaauuacaaagaaccugaauagccuuucugaacuggaggugaaaaaccuccagcgccuguccggagccauggaugagcugcauaaugaaauccucgagcuggacgaaaaggucgacgaucuuagagccgacaccauuagcucucaaaucgagcuggcugugcuccugagcaacgaaggcaucauuaauuccgaggaugagcaccuucuggcccucgaacggaaacugaagaagaugcuggggccuucugcggucgagaucggcaacggauguuucgaaacaaaacauaagugcaaucagaccugccucgaccgcauugcugccggcacguuugaugccggggaguucagccugcccaccuuugacucccuuaacaucacagcugccagccugaaugaugacggacucgauaaccacaccauucugcuguauuacucuacagcugccuccagccuugcggugacccucaugaucgccauuuucguuguguauauggucucuagagacaauguguccuguagcaucugccuguga

SEQ ID NO: 211358 - RNA, 1755 nt, Artificial Sequence; identical to SEQ ID NO: 211153
  derived and/or modified sequence opt5 from hemagglutinin__InfluenzaB__AIC73893

SEQ ID NO: 211359 - RNA, 1755 nt, Artificial Sequence; identical to SEQ ID NO: 211313
  derived and/or modified sequence opt5 from hemagglutinin__InfluenzaB__AIC73894

SEQ ID NO: 211360 - RNA, 1755 nt, Artificial Sequence; identical to SEQ ID NO: 211313
  derived and/or modified sequence opt5 from hemagglutinin__InfluenzaB__AIC73895

SEQ ID NO: 211361 - RNA, 1755 nt, Artificial Sequence; identical to SEQ ID NO: 211313
  derived and/or modified sequence opt5 from hemagglutinin__InfluenzaB__AIC73896

SEQ ID NO: 211362 - RNA, 1755 nt, Artificial Sequence; identical to SEQ ID NO: 211313
  derived and/or modified sequence opt5 from hemagglutinin__InfluenzaB__AIC73897

SEQ ID NO: 211363 - RNA, 1755 nt, Artificial Sequence; identical to SEQ ID NO: 211313
  derived and/or modified sequence opt5 from hemagglutinin__InfluenzaB__AIC73898

SEQ ID NO: 211364 - RNA, 1755 nt, Artificial Sequence; identical to SEQ ID NO: 211313
  derived and/or modified sequence opt5 from hemagglutinin__InfluenzaB__AIC73899

SEQ ID NO: 211365 - RNA, 1755 nt, Artificial Sequence; identical to SEQ ID NO: 211313
  derived and/or modified sequence opt5 from hemagglutinin__InfluenzaB__AIC73900

SEQ ID NO: 211366 - RNA, 1755 nt, Artificial Sequence; identical to SEQ ID NO: 211313
  derived and/or modified sequence opt5 from hemagglutinin__InfluenzaB__AIC73902

SEQ ID NO: 211367 - RNA, 1755 nt, Artificial Sequence
  derived and/or modified sequence opt5 from hemagglutinin__InfluenzaB__AIC73903
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggaucacaacccacuacguuagccagauuggagacuucccugaucagacggaggacggcggccugccccaaucugggcggaucgugguggauuauaugaugcagaaaccuggaaagacaggcaccaucgucuaccagcgcggggugcuccugccccagaaaguuuggugcgcuuccggaagaagcaaggugauuaaaggcucccuuccccugaucggggaagccgacugucuccaugaggaauacggaggccugaacaagucuaaaccuuauuacaccggcaagcacgcgaaggccauugggaauugcccgaucugggucaaaacaccccugaagcucgcuaacggaaccaaauaucggccucccgccaagcugcuuaaagagcgcggcuuuuucggggcuauugccggauuucuggagggcgggugggaaggcaugaucgccggauggcacggcuacacaagccauggggcucacggaguggcgguugccgcugaccucaaguccacgcaagaggccaucaacaagauuaccaaaaaucugaacagccuuucugaacuggaggugaagaaucuccagagacuguccggcgccauggaugaacugcauaacgagauccucgagcuggacgaaaaagucgaugaccuucgggcugauacaauuagcucucagaucgagcuggccgugcuccugagcaaugaagggauuaucaacuccgaggacgaacaccuucuggcgcucgagcgcaagcugaaaaagaugcugggaccuucugcugucgauaucggcaauggguguuucgagaccaagcacaaaugcaaccaaacaugccucgacagaauugccgccggcaccuuuaaugcuggagaguucagccugcccacguuugauucccuuaacaucaccgccgcuagccugaaugacgauggccucgacaaccauacaauucugcuguauuacucuaccgccgcguccagccuugccgugacacucaugcuggcuaucuucauuguuuauauggugucucgggacaaugucuccuguagcaucugccuguga

SEQ ID NO: 211368 - RNA, 1755 nt, Artificial Sequence
  derived and/or modified sequence opt5 from hemagglutinin__InfluenzaB__AIC73904
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcauuacccccucugccaaagccagcauccugcaugaagugcggccuguuacauccggguguuuucccaucaugcacgaccgcaccaagauuagacaacucccuaaucugcugcggggauaugagaagauccgccucucuacgcagaacgugauugaugcugaaaaagccccgggcggccccuacagacuggggacaagcggauccugcccuaaugcuaccagcaagaucggcuucuuugccacaauggcgugggccguccccaaagacaacuauaagaaugcuaccaacccucagaccguggaggugcccuacauuuguacagaaggggaggaucagaucacggucuggggauuccauucugacaauaaaacccaaaugaagucccuuuauggcgauagcaacccgcagaaguuuacaucuuccgccaaugggguuaccacacacuacgugagccagauuggagacuucccugaucagaccgaggacggcggccugccccaaucugggcggaucguggucgauuauaugaugcagaaaccuggaaagacgggcacaaucguguaccagcgcgggguucuccugccccagaaaguguggugcgcuuccggaagaagcaaggucauuaaaggcucccuuccccugaucggggaagccgacugucuccaugaggaauacggaggccugaacaagucuaaaccuuauuacaccggcaagcacgcgaaggccauugggaauugcccgaucugggugaaaacaccccugaagcucgcuaacggaaccaaauaucggccucccgccaagcugcuuaaagagcgcggcuuuuucggggcuauugccggauuucuggagggcgggugggaaggcaugaucgccggauggcacggcuacaccagccauggggcucacggaguugcgguggccgcugaccucaaguccacacaagaggccaucaacaagauuacgaaaaaucugaacagccuuucugaacuggaggucaagaaucuccagagacuguccggcgccauggaugaacugcauaacgagauccucgagcuggacgaaaaaguggaugaccuucgggcugauaccauuagcucucagaucgagcuggccguccuccugagcaaugaagggauuaucaacuccgaggacgaacaccuucuggcgcucgagcgcaagcugaaaaagaugcugggaccuucugcuguggauaucggcaauggguguuucgagacaaagcacaaaugcaaccaaaccugccucgacagaauugccgccggcacauuuaaugcuggagaguucagccugcccaccuuugauucccuuaacaucacggccgcuagccugaaugacgauggccucgacaaccauaccauucugcuguauuacucuacagccgcguccagccuugccguuacccucaugcuggcuaucuucauuguguauauggucucucgggacaauguguccuguagcaucugccuguga

SEQ ID NO: 211369 - RNA, 1755 nt, Artificial Sequence; identical to SEQ ID NO: 211313
  derived and/or modified sequence opt5 from hemagglutinin__InfluenzaB__AIC73905

SEQ ID NO: 211370 - RNA, 1755 nt, Artificial Sequence; identical to SEQ ID NO: 211313
  derived and/or modified sequence opt5 from hemagglutinin__InfluenzaB__AIC73906

SEQ ID NO: 211371 - RNA, 1755 nt, Artificial Sequence; identical to SEQ ID NO: 211313
  derived and/or modified sequence opt5 from hemagglutinin__InfluenzaB__AIC73907

SEQ ID NO: 211372 - RNA, 1755 nt, Artificial Sequence; identical to SEQ ID NO: 211313
  derived and/or modified sequence opt5 from hemagglutinin__InfluenzaB__AIC73908

SEQ ID NO: 211373 - RNA, 1755 nt, Artificial Sequence; identical to SEQ ID NO: 211313
  derived and/or modified sequence opt5 from hemagglutinin__InfluenzaB__AIC73909

SEQ ID NO: 211374 - RNA, 1755 nt, Artificial Sequence; identical to SEQ ID NO: 211313
  derived and/or modified sequence opt5 from hemagglutinin__InfluenzaB__AIC73910

SEQ ID NO: 211375 - RNA, 1755 nt, Artificial Sequence; identical to SEQ ID NO: 211313
  derived and/or modified sequence opt5 from hemagglutinin__InfluenzaB__AIC73911

SEQ ID NO: 211376 - RNA, 1755 nt, Artificial Sequence; identical to SEQ ID NO: 211313
  derived and/or modified sequence opt5 from hemagglutinin__InfluenzaB__AIC73912

SEQ ID NO: 211377 - RNA, 1755 nt, Artificial Sequence; identical to SEQ ID NO: 211313
  derived and/or modified sequence opt5 from hemagglutinin__InfluenzaB__AIC73913

SEQ ID NO: 211378 - RNA, 1755 nt, Artificial Sequence; identical to SEQ ID NO: 211313
  derived and/or modified sequence opt5 from hemagglutinin__InfluenzaB__AIC73914

SEQ ID NO: 211379 - RNA, 1755 nt, Artificial Sequence; identical to SEQ ID NO: 211313
  derived and/or modified sequence opt5 from hemagglutinin__InfluenzaB__AIC73915

SEQ ID NO: 211380 - RNA, 1755 nt, Artificial Sequence; identical to SEQ ID NO: 211313
  derived and/or modified sequence opt5 from hemagglutinin__InfluenzaB__AIC73916

SEQ ID NO: 211381 - RNA, 1755 nt, Artificial Sequence; identical to SEQ ID NO: 211313
  derived and/or modified sequence opt5 from hemagglutinin__InfluenzaB__AIC73917

SEQ ID NO: 211382 - RNA, 1755 nt, Artificial Sequence; identical to SEQ ID NO: 211313
  derived and/or modified sequence opt5 from hemagglutinin__InfluenzaB__AIC73918

SEQ ID NO: 211383 - RNA, 1755 nt, Artificial Sequence; identical to SEQ ID NO: 211153
  derived and/or modified sequence opt5 from hemagglutinin__InfluenzaB__AIC73919

SEQ ID NO: 211384 - RNA, 1755 nt, Artificial Sequence; identical to SEQ ID NO: 211313
  derived and/or modified sequence opt5 from hemagglutinin__InfluenzaB__AIC73920

SEQ ID NO: 211385 - RNA, 1758 nt, Artificial Sequence; identical to SEQ ID NO: 210889
  derived and/or modified sequence opt5 from hemagglutinin__InfluenzaB__AIC73921

SEQ ID NO: 211386 - RNA, 1755 nt, Artificial Sequence; identical to SEQ ID NO: 211313
  derived and/or modified sequence opt5 from hemagglutinin__InfluenzaB__AIC73922

SEQ ID NO: 211387 - RNA, 1758 nt, Artificial Sequence; identical to SEQ ID NO: 209911
  derived and/or modified sequence opt5 from hemagglutinin__InfluenzaB__AIC73924

SEQ ID NO: 211388 - RNA, 1758 nt, Artificial Sequence
  derived and/or modified sequence opt5 from hemagglutinin__InfluenzaB__AIC73925
augaaggccaccaucgugcugcucauggucguuacaagcaacgcugacagaauuugcacgggcaucaccuccucuaauagcccccacguggugaaaacagccacccagggggaggucaacgugacaggaguuauuccucugaccacaaccccgacgaagucccauuucgcgaaucuuaaaggcaccgaaacacgggggaagcugugucccaaaugccucaacuguaccgaucuggacguggcucuuggacgcccuaagugcacaggcaagauccccucugccagagucagcauucugcacgaggugcggccuguuaccuccggguguuuucccaucaugcaugaucgcacgaaaaucagacaacucccuaaucugcugcggggauacgaacacauucgccucucuacacauaacgugaucaaugccgaggacgcuccgggcggccccuauaagauugggaccagcggauccugcccuaacgucacaaauggcaacggguucuuugccaccauggcuugggccgugcccaaaaaugauaagaacaaaaccgcgacaaauccucugacgaucgaagugcccuacauuuguaccgagggagaggaccagaucacagucuggggcuuccacagcgauaacgaaacccagauggccaagcuguauggggacucuaagccgcagaaauuuacauccagcgcuaauggaguuaccacgcacuacgugucucaaauuggcggcuucccuaaccagacagaggaugggggacugccccaguccggcagaaucguggucgacuauauggugcaaaagagcgggaaaaccggaaccaucacauaccagcggggcauucuccugccucagaagguuuggugcgccucugggcgcuccaaagugaucaagggaagccuuccccugauuggcgaagcugauugucuccaugagaaauauggcgggcugaacaaguccaagcccuacuacaccggagagcacgccaaagcgaucggcaauugcccuauuugggucaagacaccgcugaaacucgccaacgggacgaaguauagacccccugcuaaacugcuuaaggaacggggauuuuucggcgccaucgcuggguuucuggagggcggaugggaaggcaugaucgccggguggcauggauacaccucucacggcgcccacgggguggcuguugcggccgaccucaagagcacacaggaggcuauuaauaaaaucaccaagaaccuuaauucccuuagcgaacuggaggugaaaaaccuccagcgccugucuggagccauggaugagcugcauaaugaaauucucgagcuggacgaaaaggucgacgaucuuagagccgacacaaucuccagccaaauugagcuggcugugcuccugucuaacgaaggcaucaucaauagcgaggaugagcaccuucuggcccucgaacggaaacugaagaagaugcuggggcccuccgcggucgagauuggcaacggauguuucgaaaccaaacauaagugcaaucagacgugccucgaccgcaucgcugccggcaccuuugaugccggggaguucucucugccuacauuugacagccuuaacauuaccgcugccucccugaaugaugacggacucgauaaccacacaauccugcuguauuacagcaccgcugccucuucccuugcggugacgcucaugauugccaucuucguuguguauauggucagcagagacaaugugucuuguuccauuugccuguga

SEQ ID NO: 211389 - RNA, 1755 nt, Artificial Sequence; identical to SEQ ID NO: 211313
  derived and/or modified sequence opt5 from hemagglutinin__InfluenzaB__AIC73926

SEQ ID NO: 211390 - RNA, 1755 nt, Artificial Sequence; identical to SEQ ID NO: 209591
  derived and/or modified sequence opt5 from hemagglutinin__InfluenzaB__AIL94977

SEQ ID NO: 211391 - RNA, 1755 nt, Artificial Sequence; identical to SEQ ID NO: 209591
  derived and/or modified sequence opt5 from hemagglutinin__InfluenzaB__AIL94988

SEQ ID NO: 211392 - RNA, 1755 nt, Artificial Sequence
  derived and/or modified sequence opt5 from hemagglutinin__InfluenzaB__AIL94999
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaacauucgccucucuacacagaaugugaucgaugcugaaaaggccccgggcggccccuacagacuggggaccagcggauccugcccuaacgcuacaagcaaaaccggcuucuuugccaccauggcgugggccguccccaaggacaauuauaaaaacgcuacaaauccucuuacgguggaggugcccuacauuuguaccgaaggggaggaucagaucacagucuggggauuccauucugacaacaagacccagaugaaaaaucuguauggcgauuccaacccgcaaaaguuuacaagcucugccaaugggguuaccacgcacuacgugucccagauuggagacuucccugaucagacagaggacggcggccucccccagagcgggcggaucguggucgauuauaugaugcaaaagccuggaaaaaccggcaccauuguguaccagcgcgggguucugcuuccccagaagguguggugcgcuucuggaagauccaaagucaucaagggcagccugccccucaucggggaagccgacugucugcaugagaaauacggaggccugaacaaguccaaaccuuauuacacaggcgaacacgcgaaggccauugggaacugcccgaucugggugaagacaccccucaaacuggcuaauggaaccaaguaucggccucccgccaaacuucugaaggagcgcggcuuuuucggggcuauugccggauuucucgagggcgggugggaaggcaugaucgccggauggcacggcuacacgucucauggggcucacggaguugcgguggccgcugaccugaaaagcacccaggaggccauuaacaagaucacaaagaaucuuaacucccugagcgaacucgaggucaaaaaucugcaaagacugucuggcgccauggaugaacuccauaacgagauccuggagcuugacgaaaagguggaugaccugcgggcugauaccauuuccagccagaucgagcucgccguccugcuuucuaaugaagggauuaucaacagcgaggacgaacaucugcucgcgcuggagcgcaaacugaagaaaaugcucggaccuuccgcuguggauauuggcaauggguguuucgagacaaagcacaagugcaaccagaccugccuggacagaaucgccgccggcacguuuaaugcuggagaguucucucuucccaccuuugauagccugaacaucacagccgcuucccucaaugacgauggccuggacaaccacaccauucugcuuuauuacagcacagccgcgucuucccucgccguuacccugaugcuggcuaucuucauuguguauauggucagccgggacaaugugucuuguuccaucugccucuga

SEQ ID NO: 211393 - RNA, 1755 nt, Artificial Sequence; identical to SEQ ID NO: 209591
  derived and/or modified sequence opt5 from hemagglutinin__InfluenzaB__AIL95010

SEQ ID NO: 211394 - RNA, 1755 nt, Artificial Sequence; identical to SEQ ID NO: 209844
  derived and/or modified sequence opt5 from hemagglutinin__InfluenzaB__AIL95021

SEQ ID NO: 211395 - RNA, 1758 nt, Artificial Sequence; identical to SEQ ID NO: 209672
  derived and/or modified sequence opt5 from hemagglutinin__InfluenzaB__AIL95032

SEQ ID NO: 211396 - RNA, 1755 nt, Artificial Sequence; identical to SEQ ID NO: 209844
  derived and/or modified sequence opt5 from hemagglutinin__InfluenzaB__AIL95043

SEQ ID NO: 211397 - RNA, 1758 nt, Artificial Sequence; identical to SEQ ID NO: 209718
  derived and/or modified sequence opt5 from hemagglutinin__InfluenzaB__AIL95054

SEQ ID NO: 211398 - RNA, 1758 nt, Artificial Sequence; identical to SEQ ID NO: 209672
  derived and/or modified sequence opt5 from hemagglutinin__InfluenzaB__AIL95065

SEQ ID NO: 211399 - RNA, 1758 nt, Artificial Sequence; identical to SEQ ID NO: 209669
  derived and/or modified sequence opt5 from hemagglutinin__InfluenzaB__AIL95076

SEQ ID NO: 211400 - RNA, 1758 nt, Artificial Sequence; identical to SEQ ID NO: 209672
  derived and/or modified sequence opt5 from hemagglutinin__InfluenzaB__AIL95087

SEQ ID NO: 211401 - RNA, 1755 nt, Artificial Sequence; identical to SEQ ID NO: 209844
  derived and/or modified sequence opt5 from hemagglutinin__InfluenzaB__AIL95098

SEQ ID NO: 211402 - RNA, 1758 nt, Artificial Sequence; identical to SEQ ID NO: 211183
  derived and/or modified sequence opt5 from hemagglutinin__InfluenzaB__AIL95109

SEQ ID NO: 211403 - RNA, 1758 nt, Artificial Sequence
  derived and/or modified sequence opt5 from hemagglutinin__InfluenzaB__AIL95120
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgagaacgcuccgggcggccccuauaagaucgggacaagcggauccugcccuaaugucaccaacggcaauggguucuuugccacaauggcuugggccgugcccaaaaacgacaagaauaaaaccgcgaccaacccucugacaauugaagugcccuacaucuguacggagggagaggaucagauuaccgucuggggcuuccacagcgacaaugaaacacagauggccaaacuuuauggggauucuaagccgcagaaguuuaccuccagcgcuaacggaguuacaacccacuacgugucucaaaucggcggcuucccuaaccagacggaggacgggggacugccccaguccggcagaaucguggucgauuauauggugcaaaagagcgggaaaacaggaaccauuaccuaccagcggggcauccuccugccucagaagguuuggugcgccucugggcgcuccaaagugauuaagggaagccuuccccugaucggcgaagcugacugucuccaugagaaauauggcgggcugaauaaguccaagcccuacuacacaggagagcacgccaaagcgauuggcaacugcccuaucugggucaagaccccgcugaaacucgccaaugggacaaaguauagacccccugcuaaacugcuuaaggaacggggauuuuucggcgccaucgcuggguuucuggagggcggaugggaaggcaugauugccggguggcauggauacacgucucacggcgcccacgggguggcuguugcggccgaucucaagagcacccaggaggcuaucaacaaaauuacaaagaaucugaacucccuuagcgaacuggaggugaaaaaucuccagcgccugucuggagccauggacgagcugcauaacgaaauccucgagcuggaugaaaaggucgacgaccuuagagccgauaccauuuccagccaaaucgagcuggcugugcuccugucuaaugaaggcaucauuaacagcgaggacgagcaccuucuggcccucgaacggaaacugaagaagaugcuggggcccuccgcggucgagaucggcaauggauguuucgaaacaaaacauaagugcaaccagaccugccucgauaaaauugcugccggcacguuugacgccggggaguucucucugccuaccuuugauagccuuaauaucacagcugccucccugaacgacgauggacucgacaaucacaccauucugcuguauuacagcacagcugccucuucccuugcggugacccucaugaucgccauuuucguuguguauauggucagccgcgauaacgugucuuguuccaucugccuguga

SEQ ID NO: 211404 - RNA, 1755 nt, Artificial Sequence; identical to SEQ ID NO: 211313
  derived and/or modified sequence opt5 from hemagglutinin__InfluenzaB__AKA54644

SEQ ID NO: 211405 - RNA, 1755 nt, Artificial Sequence
  derived and/or modified sequence opt5 from hemagglutinin__InfluenzaB__AKA54645
augaaggccaucaccgugcugcucauggucguuacaagcaacgcugacagaauuugcacgggcaucaccuccucuaauagcccccacguggugaaaacagccacccagggggaagucaacgugacaggaguuauuccucugaccacaaccccgacgaaguccuacuucgcgaaucuuaaaggcacccggacacgcgggaagcugugucccgauugccucaacuguaccgaccuggauguggcucuuggaagaccuaugugcgucggcacaacccccucugccaaagccagcauccugcaugaagugcggccuguuacguccggguguuuucccauuaugcacgaccgcacaaagaucagacaacucccuaaucugcugcggggauaugagaagauccgccucucuacccagaacgugauugaugcugaaaaagccccgggcggccccuacagacuggggacaagcggauccugcccuaaugcuaccagcaagaucggcuucuuugccaccauggcgugggccguccccaaagacaacuauaagaaugcuacaaacccucuuacgguggaggugcccuacauuuguaccgaaggggaggaucagaucacagucuggggauuccauucugacaauaaaacccagaugaagucccuguauggcgauagcaacccgcaaaaguuuacaucuuccgccgacgggguuaccacgcacuacgugagccagauuggagauuucccugaccagacagaggauggcggccucccccagucugggcggaucguggucgacuauaugaugcaaaaaccuggaaagaccggcaccauuguguaccagcgcgggguucugcuuccccagaaaguguggugcgcuuccggaagaagcaaggucaucaaaggcucccugccccucaucggggaagccgacugucugcaugaggaauacggaggccugaauaagucuaaaccuuauuacacaggcaagcacgcgaaggccauugggaacugcccgaucugggugaaaacaccccucaagcuggcuaauggaacaaaauaucggccucccgccaagcugcugaaagagcgcggcuuuuucggggcuauugccggauuucucgagggcgggugggaaggcaugaucgccggauggcacggcuacacgagccauggggcucacggaguugcgguggccgcugaucugaaguccacccaggaggccauuaacaagaucaccaaaaaccuuaauagccugucugaacucgaggucaagaaccugcaaagacuguccggcgccauggacgaacuccauaaugagauccuggagcuugaugaaaaaguggacgaucugcgggcugacaccauuagcucucagaucgagcucgccguccugcuuagcaacgaagggauuaucaauuccgaggaugaacaccuucucgcgcuggagcgcaagcugaaaaagaugcucggaccuucugcuguggacauuggcaacggguguuucgagacaaagcacaaaugcaaucagaccugccuggauagaaucgccgccggcacguuuaacgcuggagaguucagccuucccaccuuugacucccugaauaucacagccgcuagccucaacgaugacggccuggacaaucauaccauucugcuuuauuacucuacagccgcguccagccucgccguuacccugaugcuggcuaucuucauuguguauauggucucucgggauaacguguccuguagcaucugccucuga

SEQ ID NO: 211406 - RNA, 1755 nt, Artificial Sequence; identical to SEQ ID NO: 211313
  derived and/or modified sequence opt5 from hemagglutinin__InfluenzaB__AKA54646

SEQ ID NO: 211407 - RNA, 1755 nt, Artificial Sequence; identical to SEQ ID NO: 211313
  derived and/or modified sequence opt5 from hemagglutinin__InfluenzaB__AKA54647

SEQ ID NO: 211408 - RNA, 1758 nt, Artificial Sequence; identical to SEQ ID NO: 209911
  derived and/or modified sequence opt5 from hemagglutinin__InfluenzaB__AKA54648

SEQ ID NO: 211409 - RNA, 1755 nt, Artificial Sequence
  derived and/or modified sequence opt5 from hemagglutinin__InfluenzaB__AKA54649
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaauacaaccagcaagauuggcuucuuugcuaccauggccugggcgguccccaaagacaacuauaagaaugccacaaacccucuuacgguggaggugcccuacaucuguaccgaaggggaggaucagauuacagucuggggauuccauucugacaauaaaacccagaugaagucccuguauggcgauagcaacccgcaaaaguuuacaucuuccgcuaaugggguuaccacgcacuacgugagccagaucggagacuucccugaucagacagaggacggcggccucccccagucugggcggauuguggucgauuauaugaugcaaaaaccuggaaagaccggcaccaucguguaccagcgcgggguucugcuuccccagaaaguguggugcgccuccggaagaagcaaggucaucaaaggcucccugccccucauuggggaagcugacugucugcaugaggaauacggaggccugaacaagucuaaaccuuauuacacaggcaagcacgccaaggcgaucgggaauugcccgauuugggugaaaacaccccucaagcuggccaacggaacaaaauaucggccucccgcuaagcugcugaaagagcgcggcuuuuucggggccaucgcuggauuucucgagggcgggugggaaggcaugauugccggauggcacggcuacacgagccauggggcccacggaguugcuguggcggccgaccugaaguccacccaggaggcuaucaacaagaucaccaaaaaucuuaacagccugucugaacucgaggucaagaaucugcaaagacuguccggcgccauggaugaacuccauaacgagauucuggagcuugacgaaaaaguggaugaccugcgggccgauaccaucagcucucagauugagcucgcuguccugcuuagcaaugaagggaucauuaacuccgaggacgaacaccuucucgcccuggagcgcaagcugaaaaagaugcucggaccuucugcgguggauaucggcaauggguguuucgagacaaagcacaaaugcaaccagaccugccuggacagaaucgcugccggcacguuuaaugccggagaguucagccuucccaccuuugauucccugaacauuacagcugccagccucaaugacgauggccuggacaaccauaccauccugcuuuauuacucuacagcugccuccagccucgcgguuacccugaugcuggccauuuucaucguguauauggucucucgggacaauguguccuguagcauuugccucuga

SEQ ID NO: 211410 - RNA, 1755 nt, Artificial Sequence; identical to SEQ ID NO: 211313
  derived and/or modified sequence opt5 from hemagglutinin__InfluenzaB__AKU40581

SEQ ID NO: 211411 - RNA, 1755 nt, Artificial Sequence; identical to SEQ ID NO: 211313
  derived and/or modified sequence opt5 from hemagglutinin__InfluenzaB__AKU40592

SEQ ID NO: 211412 - RNA, 1755 nt, Artificial Sequence; identical to SEQ ID NO: 211153
  derived and/or modified sequence opt5 from hemagglutinin__InfluenzaB__AKU40603

SEQ ID NO: 211413 - RNA, 1755 nt, Artificial Sequence; identical to SEQ ID NO: 211313
  derived and/or modified sequence opt5 from hemagglutinin__InfluenzaB__AKU40614

SEQ ID NO: 211414 - RNA, 1755 nt, Artificial Sequence; identical to SEQ ID NO: 211153
  derived and/or modified sequence opt5 from hemagglutinin__InfluenzaB__AKU40625

SEQ ID NO: 211415 - RNA, 1755 nt, Artificial Sequence
  derived and/or modified sequence opt5 from hemagglutinin__InfluenzaB__AKU40636
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccggcgaaguccuacuucgcuaaucuuaaaggcacccggacgcgcgggaagcugugucccgauugccucaacuguaccgaccuggauguggcccuuggaagaccuaugugcgucggcacaacccccucugccaaagcuagcauucugcaugaagugcggccuguuacauccggguguuuucccaucaugcacgaccgcaccaagaucagacaacucccuaaucugcugcggggauaugagaacauucgccucucuacgaagaaugugaucgaugccgaaaaagcuccgggcggccccuacagacuggggacaagcggauccugcccuaacgccaccagcaagauuggcuucuuugcgacaauggccugggcuguccccaaagacaauuauaagaacgccaccaauccucuuaccguggaggugcccuacaucuguaaagaaggggaggaucagauuacagucuggggauuccauucugacaacaagacgcagaugaagaaucuguauggcgauuccaacccgcagaaauuuaccagcucugcuaaugggguuacaacccacuacgugucccaaaucggagacuucccugaucagacagaggacggcggccucccccagagcgggcggauuguggucgauuauaugaugcagaagccuggaaaaaccggcacgaucguguaccaacgcgggguucugcuuccccagaagguguggugcgccucuggaagauccaaagucaucaagggcagccugccccucauuggggaagcggacugucugcaugaggaauacggaggccugaacaaauccaagccuuauuacacaggcaagcacgccaaagcuaucgggaacugcccgauuugggugaagacaccccucaaacuggccaauggaaccaaguaucggccucccgcuaaacuucugaaggagcgcggcuuuuucggggccaucgccggauuucucgagggcgggugggaaggcaugauugcuggauggcacggcuacaccucucauggggcgcacggaguugccguggcugccgaccuuaagagcacccaggaggccaucaacaaaaucacaaagaaucugaacucccugagcgaacucgaggucaaaaaucugcagagacugucuggcgcuauggaugaacuccauaacgagauucuggagcuugacgaaaagguggaugaccugcgggccgauacgaucuccagccaaauugagcucgcgguccugcuuucuaaugaagggaucauuaacagcgaggacgaacaucugcucgcucuggagcgcaaacugaagaagaugcucggaccuuccgccguggauaucggcaauggguguuucgagaccaaacacaagugcaaccagacaugccuggacagaaucgccgcuggcaccuuuaaugccggagaguucucucuucccacauuugauagccugaacauuaccgcugccucccucaaugacgauggccuggacaaccacacgauccugcuuuauuacagcaccgcggccucuucccucgcuguuacacugaugcuggccauuuucaucguguauauggucagccgggacaaugugucuuguuccauuugccucuga

SEQ ID NO: 211416 - RNA, 1755 nt, Artificial Sequence
  derived and/or modified sequence opt5 from hemagglutinin__InfluenzaB__AKU40647
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggagauccccuacauuuguacggaaggggaggaucagaucaccguguggggauuccauucugacaauaaaacacaaaugaagucccuuuauggcgauagcaacccgcagaaguuuaccucuuccgccaauggggucacaacccacuacguuagccagauuggagacuucccugaucagacggaggacggcggccugccccaaucugggcggaucgugguggauuauaugaugcagaaaccuggaaagacaggcaccaucgucuaccagcgcggggugcuccugccccagaaaguuuggugcgcuuccggaagaagcaaggugauuaaaggcucccuuccccugaucggggaagccgacugucuccaugaggaauacggaggccugaacaagucuaaaccuuauuacaccggcaagcacgcgaaggccauugggaauugcccgaucugggucaaaacaccccugaagcucgcuaacggaaccaaauaucggccucccgccaagcugcuuaaagagcgcggcuuuuucggggcuauugccggauuucuggagggcgggugggaaggcaugaucgccggauggcacggcuacacaagccauggggcucacggaguggcgguugccgcugaccucaaguccacgcaagaggccaucaacaagauuaccaaaaaucugaacagccuuucugaacuggaggugaagaaucuccagagacuguccggcgccauggaugaacugcauaacgagauccucgagcuggacgaaaaagucgaugaccuucgggcugauacaauuagcucucagaucgagcuggccgugcuccugagcaaugaagggauuaucaacuccgaggacgaacaccuucuggcgcucgagcgcaagcugaaaaagaugcugggaccuucugcugucgauaucggcaauggguguuucgagaccaagcacaaaugcaaccaaacaugccucgacagaauugccgccggcaccuuuaaugcuggagaguucagccugcccacguuugauucccuuaacaucaccgccgcuagccugaaugacgauggccucgacaaccauacaauucugcuguauuacucuaccgccgcguccagccuugccgugacacucaugcuggcuaucuucauuguuuauauggugucucgggacaaugucuccuguagcaucugccuguga

SEQ ID NO: 211417 - RNA, 1755 nt, Artificial Sequence; identical to SEQ ID NO: 211313
  derived and/or modified sequence opt5 from hemagglutinin__InfluenzaB__AKU40658

SEQ ID NO: 211418 - RNA, 1755 nt, Artificial Sequence; identical to SEQ ID NO: 211313
  derived and/or modified sequence opt5 from hemagglutinin__InfluenzaB__AKU40669

SEQ ID NO: 211419 - RNA, 1755 nt, Artificial Sequence; identical to SEQ ID NO: 211313
  derived and/or modified sequence opt5 from hemagglutinin__InfluenzaB__AKU40680

SEQ ID NO: 211420 - RNA, 1755 nt, Artificial Sequence
  derived and/or modified sequence opt5 from hemagglutinin__InfluenzaB__AKU40691
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaguuccauaacgaaauucuggagcucgacgaaaaaguggaugaccugcgggcugauacaaucagcucucagauugagcuugccguccugcucagcaaugaagggaucauuaacuccgaggacgaacaucugcuugcgcuggagcgcaagcucaaaaagaugcugggaccuucugcuguggauaucggcaauggguguuuugagaccaagcacaaaugcaaccaaacaugccuggacagaaucgccgccggcaccuucaaugcuggagaauuuagccuccccacguucgauucccugaacauuaccgccgcuagccuuaaugacgauggccuggacaaccacacaauccuccuguauuacucuaccgccgcguccagccuggccguuacacuuaugcucgcuauuuucaucguguauauggucucucgggacaauguguccuguagcauuugccuguga

SEQ ID NO: 211421 - RNA, 1755 nt, Artificial Sequence; identical to SEQ ID NO: 211313
  derived and/or modified sequence opt5 from hemagglutinin__InfluenzaB__AKU40702

SEQ ID NO: 211422 - RNA, 1755 nt, Artificial Sequence; identical to SEQ ID NO: 211313
  derived and/or modified sequence opt5 from hemagglutinin__InfluenzaB__AKU40713

SEQ ID NO: 211423 - RNA, 1755 nt, Artificial Sequence; identical to SEQ ID NO: 211153
  derived and/or modified sequence opt5 from hemagglutinin__InfluenzaB__AKU40724

SEQ ID NO: 211424 - RNA, 1755 nt, Artificial Sequence; identical to SEQ ID NO: 211416
  derived and/or modified sequence opt5 from hemagglutinin__InfluenzaB__AKU40735

SEQ ID NO: 211425 - RNA, 1755 nt, Artificial Sequence; identical to SEQ ID NO: 211313
  derived and/or modified sequence opt5 from hemagglutinin__InfluenzaB__AKU40746

SEQ ID NO: 211426 - RNA, 1755 nt, Artificial Sequence; identical to SEQ ID NO: 211313
  derived and/or modified sequence opt5 from hemagglutinin__InfluenzaB__AKU40757

SEQ ID NO: 211427 - RNA, 1755 nt, Artificial Sequence; identical to SEQ ID NO: 211313
  derived and/or modified sequence opt5 from hemagglutinin__InfluenzaB__AKU40768

SEQ ID NO: 211428 - RNA, 1755 nt, Artificial Sequence; identical to SEQ ID NO: 211313
  derived and/or modified sequence opt5 from hemagglutinin__InfluenzaB__AKU40779

SEQ ID NO: 211429 - RNA, 1755 nt, Artificial Sequence; identical to SEQ ID NO: 211153
  derived and/or modified sequence opt5 from hemagglutinin__InfluenzaB__AKU40790

SEQ ID NO: 211430 - RNA, 1755 nt, Artificial Sequence; identical to SEQ ID NO: 211313
  derived and/or modified sequence opt5 from hemagglutinin__InfluenzaB__AKU40801

SEQ ID NO: 211431 - RNA, 1755 nt, Artificial Sequence
  derived and/or modified sequence opt5 from hemagglutinin__InfluenzaB__AKU40812
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacaaaugcaaccaaacaugccucgacagaaucgccgccggcaccuuuaaugcuggagaguucagccugcccacguuugauucccuuaacauuaccgccgcuagccugaaugacgauggccucgacucucauacaauccugcuguauuacuccaccgccgcgagcucucuugccguuacacucaugcuggcuauuuucaucguguauauggucucccgggacaacgugagcuguuccauuugccuguga

SEQ ID NO: 211432 - RNA, 1755 nt, Artificial Sequence; identical to SEQ ID NO: 211313
  derived and/or modified sequence opt5 from hemagglutinin__InfluenzaB__AKU40823

SEQ ID NO: 211433 - RNA, 1755 nt, Artificial Sequence; identical to SEQ ID NO: 211313
  derived and/or modified sequence opt5 from hemagglutinin__InfluenzaB__AKU40834

SEQ ID NO: 211434 - RNA, 1755 nt, Artificial Sequence; identical to SEQ ID NO: 211313
  derived and/or modified sequence opt5 from hemagglutinin__InfluenzaB__AKU40845

SEQ ID NO: 211435 - RNA, 1755 nt, Artificial Sequence; identical to SEQ ID NO: 211313
  derived and/or modified sequence opt5 from hemagglutinin__InfluenzaB__AKU40856

SEQ ID NO: 211436 - RNA, 1755 nt, Artificial Sequence; identical to SEQ ID NO: 211313
  derived and/or modified sequence opt5 from hemagglutinin__InfluenzaB__AKU40867

SEQ ID NO: 211437 - RNA, 1755 nt, Artificial Sequence; identical to SEQ ID NO: 211313
  derived and/or modified sequence opt5 from hemagglutinin__InfluenzaB__AKU40878

SEQ ID NO: 211438 - RNA, 1758 nt, Artificial Sequence
  derived and/or modified sequence opt5 from hemagglutinin__InfluenzaB__AKU40889
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacgucaccaauggcaacggguucuuugccacaauggcuugggccgugcccaaaaaugauaagaacaaaaccgcgaccaauccucugacaacggaagugcccuacauuuguaccgagggagaggaccagaucacagucuggggcuuccacagcgauaacgaaacccagauggccaagcuguauggggacucuaagccgcagaaauuuacauccagcgcuaauggaguuaccacgcacuacgugucucaaauuggcggcuucccuaaccagacagaggaugggggacugccccaguccggcagaaucguggucgacuauauggugcaaaagagcgggaaaaccggaaccaucacauaccagcggggcauucuccugccucagaagguuuggugcgccucugggcgcuccaaagugaucaagggaagccuuccccugauuggcgaagcugauugucuccaugagaaauauggcgggcugaacaaguccaagcccuacuacaccggagagcacgccaaagcgaucggcaauugcccuauuugggucaagacaccgcugaaacucgccaacgggacgaaguauagacccccugcuaaacugcuuaaggaacggggauuuuucggcgccaucgcuggguuucuggagggcggaugggaaggcaugaucgccggguggcauggauacaccucucacggcgcccacgggguggcuguugcggccgaccucaagagcacacaggaggcuauuaauaaaaucaccaagaaccuuaauucccuuagcgaacuggaggugaaaaaccuccagcgccugucuggagccauggaugagcugcauaaugaaauucucgagcuggacgaaaaggucgacgaucuuagagccgacacaaucuccagccaaauugagcuggcugugcuccugucuaacgaaggcaucaucaauagcgaggaugagcaccuucuggcccucgaacggaaacugaagaagaugcuggggcccuccgcggucgagauuggcaacggauguuucgaaaccaaacauaagugcaaucagacgugccucgaccgcaucgcugccggcaccuuugaugccggggaguucucucugccuacauuugacagccuuaacauuaccgcugccucccugaaugaugacggacucgauaaccacacaauccugcuguauuacagcaccgcugccucuucccuugcggugacgcucaugauugccaucuucguuguguauauggucagcagagacaaugugucuuguuccauuugccuguga

SEQ ID NO: 211439 - RNA, 1755 nt, Artificial Sequence; identical to SEQ ID NO: 211313
  derived and/or modified sequence opt5 from hemagglutinin__InfluenzaB__AKU40900

SEQ ID NO: 211440 - RNA, 1755 nt, Artificial Sequence; identical to SEQ ID NO: 211153
  derived and/or modified sequence opt5 from hemagglutinin__InfluenzaB__AKU40911

SEQ ID NO: 211441 - RNA, 1755 nt, Artificial Sequence
  derived and/or modified sequence opt5 from hemagglutinin__InfluenzaB__AKU40922
augaaggccaucauugugcugcucauggucguuaccagcaacgcugacagaaucugcacaggcauuacguccucuaauagcccccacguggugaaaaccgucacacagggggaagugaacguuaccggagugaucccucugacaaccacaccgaccaaguccuacuucgccaaucuuaaaggcacgcggacccgcgggaagcugugucccgauugccucaacuguacagaccuggaugucgcgcuuggaagaccuaugugcgugggcaccacacccucugcuaaagccagcauucugcaugaaguucggccugugaccuccggguguuuucccaucaugcacgaccgcacgaagaucagacaacucccuaaucugcugcggggauaugagaagauucgccucucuacacagaacgucaucgaugccgaaaaagcuccgggcggccccuacagacuggggaccagcggauccugcccuaaugccacaagcaagauuggcuucuuugcuaccauggccugggcggugcccaaagacaacuauaagaaugccaccaacccucagacaguggagguccccuacaucuguacggaaggggaggaucagauuaccguuuggggauuccauucugacaauaaaacacaaaugaagucccuuuauggcgauagcaacccgcagaaguuuaccucuuccgcuaauggggugacaacccacuacgugagccagaucggagacuucccugaucagacggaggacggcggccugccccaaucugggcggauugucguggauuauaugaugcagaaaccuggaaagacaggcaccaucguuuaccagcgcggggugcuccugccccagaaagucuggugcgccuccggaagaagcaaggugaucaaaggcucccuuccccugauuggggaagcugacugucuccaugaggaauacggaggccugaacaagucuaaaccuuauuacaccggcaagcacgccaaggcgaucgggaauugcccgauuuggguuaaaacaccccugaagcucgccaacggaaccaaauaucggccucccgcuaagcugcuuaaagagcgcggcuuuuucggggccaucgcuggauuucuggagggcgggugggaaggcaugauugccggauggcacggcuacacaagccauggggcccacggaguggcugucgcggccgaccucaaguccacgcaagaggcuaucaacaagaucaccaaaaaucugaacagccuuucugaacuggaggugaagaaucuccagagacuguccggcgccauggaugaacugcauaacgagauucucgagcuggacgaaaaagucgaugaccuucgggccgauacaaucagcucucagauugagcuggcugugcuccugagcaaugaagggaucauuaacuccgaggacgaacaccuucuggcccucgagcgcaagcugaaaaagaugcugggaccuucugcgguugauaucggcaauggguguuucgagaccaagcacaaaugcaaccaaacaugccucgacagaaucgcugccggcaccuuuaaugccggagaguucagccugcccacguuugauucccuuaacauuaccgcugccagccugaaugacgauggccucgacaaccauacaauccugcuguauuacucuaccgcugccuccagccuugcggugacacucaugcuggccauuuucaucgucuauauggugucucgggacaauguuuccuguagcauuugccuguga

SEQ ID NO: 211442 - RNA, 1755 nt, Artificial Sequence; identical to SEQ ID NO: 211416
  derived and/or modified sequence opt5 from hemagglutinin__InfluenzaB__AKU40933

SEQ ID NO: 211443 - RNA, 1755 nt, Artificial Sequence; identical to SEQ ID NO: 211313
  derived and/or modified sequence opt5 from hemagglutinin__InfluenzaB__AKU40944

SEQ ID NO: 211444 - RNA, 1755 nt, Artificial Sequence; identical to SEQ ID NO: 211313
  derived and/or modified sequence opt5 from hemagglutinin__InfluenzaB__AKU40955

SEQ ID NO: 211445 - RNA, 1755 nt, Artificial Sequence; identical to SEQ ID NO: 211313
  derived and/or modified sequence opt5 from hemagglutinin__InfluenzaB__AKU40966

SEQ ID NO: 211446 - RNA, 1755 nt, Artificial Sequence; identical to SEQ ID NO: 211313
  derived and/or modified sequence opt5 from hemagglutinin__InfluenzaB__AKU40977

SEQ ID NO: 211447 - RNA, 1755 nt, Artificial Sequence; identical to SEQ ID NO: 211313
  derived and/or modified sequence opt5 from hemagglutinin__InfluenzaB__AKU40987

SEQ ID NO: 211448 - RNA, 1755 nt, Artificial Sequence; identical to SEQ ID NO: 211313
  derived and/or modified sequence opt5 from hemagglutinin__InfluenzaB__AKU40998

SEQ ID NO: 211449 - RNA, 1755 nt, Artificial Sequence; identical to SEQ ID NO: 211313
  derived and/or modified sequence opt5 from hemagglutinin__InfluenzaB__AKU41009

SEQ ID NO: 211450 - RNA, 1755 nt, Artificial Sequence; identical to SEQ ID NO: 211313
  derived and/or modified sequence opt5 from hemagglutinin__InfluenzaB__AKU41020

SEQ ID NO: 211451 - RNA, 1755 nt, Artificial Sequence; identical to SEQ ID NO: 211313
  derived and/or modified sequence opt5 from hemagglutinin__InfluenzaB__ALA08485

SEQ ID NO: 211452 - RNA, 1755 nt, Artificial Sequence; identical to SEQ ID NO: 211313
  derived and/or modified sequence opt5 from hemagglutinin__InfluenzaB__ALA08486

SEQ ID NO: 211453 - RNA, 1755 nt, Artificial Sequence; identical to SEQ ID NO: 211313
  derived and/or modified sequence opt5 from hemagglutinin__InfluenzaB__ALA08487

SEQ ID NO: 211454 - RNA, 1755 nt, Artificial Sequence; identical to SEQ ID NO: 211313
  derived and/or modified sequence opt5 from hemagglutinin__InfluenzaB__ALA08564

SEQ ID NO: 211455 - RNA, 1755 nt, Artificial Sequence; identical to SEQ ID NO: 211313
  derived and/or modified sequence opt5 from hemagglutinin__InfluenzaB__ALA08565

SEQ ID NO: 211456 - RNA, 1755 nt, Artificial Sequence; identical to SEQ ID NO: 211313
  derived and/or modified sequence opt5 from hemagglutinin__InfluenzaB__ALA08566

SEQ ID NO: 211457 - RNA, 1755 nt, Artificial Sequence; identical to SEQ ID NO: 211313
  derived and/or modified sequence opt5 from hemagglutinin__InfluenzaB__ALA08567

SEQ ID NO: 211458 - RNA, 1755 nt, Artificial Sequence; identical to SEQ ID NO: 211313
  derived and/or modified sequence opt5 from hemagglutinin__InfluenzaB__ALA08568

SEQ ID NO: 211459 - RNA, 1755 nt, Artificial Sequence; identical to SEQ ID NO: 211313
  derived and/or modified sequence opt5 from hemagglutinin__InfluenzaB__ALA08569

SEQ ID NO: 211460 - RNA, 1758 nt, Artificial Sequence
  derived and/or modified sequence opt5 from hemagglutinin__InfluenzaB__ALA08689
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugcccuaacuguacagaucucgacguggcucugggacgccccaagugcaccggcaagauuccuucugccagagucagcauccuucacgaggugcggcccguuacauccggguguuuuccuaucaugcaugaucgcaccaaaauuagacaacugccgaaucuccugcggggauacgaacacauccgccugucuacgcauaacgugauuaaugccgagaacgcucccggcggcccuuauaagaucgggacaagcggauccugccccaaugucaccaacggcaauggguucuuugccacaauggcuugggccgugccuaaaaacgacaagaauaaaaccgcgaccaacccccucacaauugaagugccguacaucuguacggagggagaggaucagauuaccgucuggggcuuccacagcgacaaugaaacacagauggccaagcuguauggggauucuaacccucagaaguuuaccuccagcgcuaacggaguuacaacccacuacgugucucaaaucggcggcuuccccaaucagacggaggacgggggacuuccucaguccggcagaaucguggucgauuauauggugcagaaaagcgggaagacaggaaccauuaccuaccaacggggcauccugcucccccagaaaguuuggugcgccucugggcgcuccaaggugauuaaaggaagccugccccuuaucggcgaagcugacugucugcaugagaaguauggcgggcucaacaaauccaagccuuacuacacaggagagcacgccaaggcgauuggcaauugcccgaucugggucaaaacaccccugaagcuggccaacgggacaaaauauagaccucccgcuaagcuccugaaagaacggggauuuuucggcgccaucgcuggguuucuugagggcggaugggaaggcaugauugccggguggcauggauacacgucucacggcgcccacgggguggcuguugcggccgaucugaaaagcacccaggaggcuaucaauaagauuaccaagaaccucaauucccugagcgaacuugaggugaagaaccugcagcgccucucuggagccauggacgagcugcauaaugaaauccuggagcucgaugaaaaagucgacgaccugagagccgauaccauuuccagccaaaucgagcuugcugugcugcucucuaacgaaggcaucauuaauagcgaggacgagcaucugcuugcccuggaacggaagcucaaaaagaugcuggggccuuccgcggucgagaucggcaacggauguuucgaaacaaagcacaaaugcaaucagaccugccuggaucgcauugcugccggcacguuugacgccggggaguucucucuccccaccuuugauagccugaacaucacagcugccucccuuaaugacgauggacuggacaaccacaccauucuccuguauuacagcacagcugccucuucccuggcggugacccuuaugaucgccauuuucguuguguauauggucagcagagauaacgugucuuguuccaucugccucuga

SEQ ID NO: 211461 - RNA, 1758 nt, Artificial Sequence
  derived and/or modified sequence opt5 from hemagglutinin__InfluenzaB__ALA08690
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacauuaccaauggcaacggguucuuugccacaauggcuugggccguccagaaaaaugauaagaacaaaaccgcgaccaauccccugacaaucgaagugccuuacauuuguacggagggagaggaccagaucaccguguggggcuuccacagcgauaacgaaacacagauggccaagcuguauggggacucuaagccccaaaaauuuaccuccagcgcuaauggagucacaacccacuacguuucucagaucggcggcuucccgaaccagacggaggaugggggacugccucaguccggcagaauugugguggacuauaugguccaaaagagcgggaaaacaggaaccaucaccuaccagcggggcauucuccugccccagaagguguggugcgccucugggcgcuccaaaguuaucaagggaagccuuccucugauuggcgaagcugauugucuccaugagaaauauggcgggcugaacaaguccaagcccuacuacacaggagagcacgccaaagcgaucggcaauugccccaucugggugaagaccccucugaaacucgccaacgggacaaaguauagaccgcccgcuaaacugcuuaaggaacggggauuuuucggcgccauugcuggguuucuggagggcggaugggaaggcaugaucgccggguggcauggauacacgucucacggcgcccacggggucgcuguggcggccgaccucaagagcacccaggaggcuauuaauaaaaucacaaagaaccuuaauucccuuagcgaacuggagguuaaaaaccuccaacgccugucuggagccauggaugagcugcauaaugaaauucucgagcuggacgaaaagguggacgaucuuagagccgacaccaucuccagccagaucgagcuggcuguccuccugucuaacgaaggcauuaucaauagcgaggaugagcaccuucuggcccucgaacggaaacugaagaagaugcuggggccuuccgcgguggagauuggcaacggauguuucgaaacaaaacauaagugcaaucagaccugccucgaccgcaucgcugccggcacguuugaugccggggaguucucucugcccaccuuugacagccuuaacauuacagcugccucccugaaugaugacggacucgaugaccacaccauccugcuguauuacagcacagcugccucuucccuugcggucacccucaugauugccaucuucgugguuuauauggugagcagagauaacgucucuuguuccaucugccuguga

SEQ ID NO: 211462 - RNA, 1755 nt, Artificial Sequence; identical to SEQ ID NO: 211313
  derived and/or modified sequence opt5 from hemagglutinin__InfluenzaB__ALE31766

SEQ ID NO: 211463 - RNA, 1758 nt, Artificial Sequence
  derived and/or modified sequence opt5 from hemagglutinin__InfluenzaB__ALE31768
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacauuaccaauggcaacggguucuuugccacaauggcuugggccguccccaaaaaugauaagaacaaaaccgcgaccaauccucugacaaucgaagugcccuacauuuguacggagggagaggaccagaucaccguguggggcuuccacagcgauaacgaaacacagauggccaagcuguauggggacucuaagccgcagaaauuuaccuccagcgcuaauggagucacaacccacuacguuucucaaaucggcggcuucccuaaccagacggaggaugggggacugccccaguccggcagaauugugguggacuauaugguccaaaagagcgggaaaacaggaaccaucaccuaccagcggggcauucuccugccucagaagguguggugcgccucugggcgcuccaaaguuaucaagggaagccuuccccugauuggcgaagcugauugucuccaugagaaauauggcgggcugaacaaguccaagcccuacuacacaggagagcacgccaaagcgaucggcaauugcccuaucugggugaagaccccgcugaaacucgccaacgggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaccucaagagcacccaggaggcuauuaauaaaaucacaaagaaccuuaauucccuuagcgaacuggagguuaaaaaccuccagcgccugucuggagccauggaugagcugcauaaugaaauucucgagcuggacgaaaagguggacgaucuuagagccgacaccaucuccagccaaaucgagcuggcuguccuccugucuaacgaaggcauuaucaauagcgaggaugagcaccuucuggcccucgaacggaaacugaagaagaugcuggggcccuccgcgguggagauuggcaacggauguuucgaaacaaaacauaagugcaaucagaccugccucgaccgcaucgcugccggcacguuugaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaaugucucuuguuccaucugccuguga

SEQ ID NO: 211464 - RNA, 1758 nt, Artificial Sequence
  derived and/or modified sequence opt5 from hemagglutinin__InfluenzaB__ALE31770
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacaucucucucagcacgcauaacgugauuaaugccgaggacgcuccgggcggccccuauaagaucgggacauccggaagcugcccuaacgucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacucugauaacgaaacacagauggccaaacuuuauggggacuccaagccgcagaaguuuaccagcucugcuaauggaguuacaacccacuacgugucccaaaucggcggcuucccuaaccagacggaggaugggggacugccccagagcggccgcaucguggucgacuauauggugcagaagucugggaaaacaggaaccauuaccuaccaaagaggcauccuccugccucagaagguuuggugcgccuccgggcggagcaaagugauuaagggaucccuuccccugaucggcgaagcugauugucuccaugagaaauauggcgggcugaacaagucuaagcccuacuacacaggagagcacgccaaagcgauuggcaauugcccuaucugggucaagaccccgcugaaacucgccaacgggacaaaguauagacccccugcuaaacugcuuaaggaacgcggauuuuucggcgccaucgcuggguuucuggagggcggaugggaaggcaugauugccggguggcauggauacacgagccacggcgcccacgggguggcuguugcggccgaccucaaguccacccaggaggcuaucaauaaaauuacaaagaaccugaauagccuuucugaacuggaggugaaaaaccuccagcggcuguccggagccauggaugagcugcauaaugaaauccucgagcuggacgaaaaggucgacgaucuucgcgccgacaccauuagcucucaaaucgagcuggcugugcuccugagcaacgaaggcaucauuaauuccgaggaugagcaccuucuggcccucgaaagaaaacugaagaagaugcuggggcccucugcggucgagaucggcaacggauguuucgaaacaaaacauaagugcaaucagaccugccucgaccggauugcugccggcacguuugaugccggggaguucagccugccuaccuuugacucccuuaacaucacagcugccagccugaaugaugacggacucgauaaccacaccauucugcuguauuacucuacagcugccuccagccuugcggugacccucaugaucgccauuuucguuguguauauggucucucgcgacaauguguccuguagcaucugccuguga

SEQ ID NO: 211465 - RNA, 1755 nt, Artificial Sequence; identical to SEQ ID NO: 211313
  derived and/or modified sequence opt5 from hemagglutinin__InfluenzaB__ALE31772

SEQ ID NO: 211466 - RNA, 1755 nt, Artificial Sequence; identical to SEQ ID NO: 211313
  derived and/or modified sequence opt5 from hemagglutinin__InfluenzaB__ALE31773

SEQ ID NO: 211467 - RNA, 1755 nt, Artificial Sequence
  derived and/or modified sequence opt5 from hemagglutinin__InfluenzaB__ALE31884
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacaaaugcaaccaaacaugccucgacagaaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccguuacacucaugcuggcuauuuucaucguguauauggucucucgggacaauguguccuguagcguuugccuguga

SEQ ID NO: 211468 - RNA, 1755 nt, Artificial Sequence
  derived and/or modified sequence opt5 from hemagglutinin__InfluenzaB__ALE31885
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacaaaugcaaccaaacaugccucgacagaaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccguuacacucaugcuggcuauuuucguggucuauauggugucucgggacaauguuuccuguagcaucugccuguga

SEQ ID NO: 211469 - RNA, 1755 nt, Artificial Sequence; identical to SEQ ID NO: 211313
  derived and/or modified sequence opt5 from hemagglutinin__InfluenzaB__ALE31886

SEQ ID NO: 211470 - RNA, 1755 nt, Artificial Sequence
  derived and/or modified sequence opt5 from hemagglutinin__InfluenzaB__ALE31887
augaaggccaucauugugcugcucauggucguuaccagcaacgcugacagaaucugcacaggcauuacguccucuaauagcccccacguggugaaaaccgccacacagggggaaaucaacgucaccggagugauuccucugacaaccacaccgaccaaguccuacuucgcgaaucuuaaaggcacgcggacccgcgggaagcugugucccgauugccucaacuguacagaccuggauguugcucuuggaagaccuaugugcgugggcaccacacccucugccaaagccagcauccugcaugaaguccggccugugaccuccggguguuuucccaucaugcacgaccgcacgaagauuagacaacucccuaaucugcugcggggauaugagaagauccgccucucuacacagaacguuauugaugcugaaaaagccccgggcggccccuacagacuggggaccagcggauccugcccuaaugcuacaagcaagaucggcuucuuugccaccauggcgugggccgugcccaaagacaacuauaagaaugcuaccaacccucagacagucgaggugcccuacauuuguacggaaggggaggaucagaucaccguguggggauuccauucugacaauaaaacacaaaugaagucccuuuauggcgauagcaacccgcagaaguuuaccucuuccgccaauggggucacaacccacuacguuagccagauuggagacuucccugaucagacggaggacggcggccugccccaaucugggcggaucgugguggauuauaugaugcagaaaccuggaaagacaggcaccaucgucuaccagcgcggggugcuccugccccagaaaguuuggugcgcuuccggaagaagcaaggugauuaaaggcucccuuccccugaucggggaagccgacugucuccaugaggaauacggaggccugaacaagucuaaaccuuauuacaccggcaagcacgcgaaggccauugggaauugcccgaucugggucaaaacaccccugaagcucgcuaacggaaccaaauaucggccucccgccaagcugcuuaaagagcgcggcuuuuucggggcuauugccggauuucuggagggcgggugggaaggcaugaucgccggauggcacggcuacacaagccauggggcucacggaguggcgguugccgcugaccucaaguccacgcaagaggccaucaacaagauuaccaaaaaucugaacagccuuucugaacuggaggugaagaaucuccagagacuguccggcgccauggaugaacugcauaacgagauccucgagcuggacgaaaaagucgaugaccuucgggcugauacaauuagcucucagaucgagcuggccgugcuccugagcaaugaagggauuaucaacuccgaggacgaacaccuucuggcgcucgagcgcaagcugaaaaagaugcugggaccuucugcugucgauaucggcaauggguguuucgagaccaagcacaaaugcaaccaaacaugccucgacagaauugccgccggcaccuuuaaugcuggagaguucagccugcccacguuugauucccuuaacaucaccgccgcuagccugaaugacgauggccucgacaaccauacaauucugcuguauuacucuaccgccgcguccagccuugccgugacacucaugcuggcuaucuucauuguuuauauggugucucgggacaaugucuccuguagcaucugccuguga

SEQ ID NO: 211471 - RNA, 1755 nt, Artificial Sequence; identical to SEQ ID NO: 211313
  derived and/or modified sequence opt5 from hemagglutinin__InfluenzaB__ALE31982

SEQ ID NO: 211472 - RNA, 1755 nt, Artificial Sequence
  derived and/or modified sequence opt5 from hemagglutinin__InfluenzaB__ALE31983
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaacaagucuaaaccuuauuacaccggcaagcacgcgaaggccaucgggaauugcccgauuugggugaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaccucaaguccacgcaagaggccaucaacaagaucaccaaaaaucugaacagccuuucugaacuggaggucaagaaucuccagagacuguccggcgccauggaugaacugcauaacgagauucucgagcuggacgaaaaaguggaugaccuucgggcugauacaaucagcucucagauugagcuggccguccuccugagcaaugaagggaucauuaacuccgaggacgaacaccuucuggcgcucgagcgcaagcugaaaaagaugcugggaccuucugcuguggauaucggcaauggguguuucgagaccaagcacaaaugcaaccaaacaugccucgacagaaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccguuacacucaugcuggcucuguucauuguguauauggucucucgggacaauguguccuguagcaucugccucuga

SEQ ID NO: 211473 - RNA, 1755 nt, Artificial Sequence
  derived and/or modified sequence opt5 from hemagglutinin__InfluenzaB__ALE31984
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaagaggaggaucagauuaccgucuggggguuccauucugacaauaaaacacaaaugaagucccuuuauggagauagcaacccgcagaaguuuaccucuuccgccaauggcguuacaacccacuacgugagccagaucggggacuucccugaucagacggaagacggaggccugccccaaucuggccggauuguggucgauuauauggugcagaaaccugggaagacaggaaccaucguuuaccagcgcggcgugcuccugccccagaaagucuggugcgcuuccgggagaagcaaggugaucaaaggaucccuuccccugauuggcgaggccgacugucuccaugaagaguacgggggacugaacaagucuaaaccuuauuacaccggcaagcacgcgaaggccaucggcaauugcccgauuuggguuaaaacaccccugaagcucgcuaacgggaccaaauaucggccucccgccaagcugcuuaaagagcgcggauuuuucggcgcuaucgccggguuucuggaaggaggcugggaggggaugauugccggcuggcacggauacacaagccauggcgcucacgggguggcggucgccgcugaccucaaguccacgcaagaagccaucaacaagaucaccaaaaaucugaacagccuuucugagcuggaagugaagaaucuccagagacuguccggagccauggaugagcugcauaacgagauucucgaacuggacgagaaagucgaugaccuucgggcugauacaaucagcucucagauugaacuggccgugcuccugagcaaugagggcaucauuaacuccgaagacgagcaccuucuggcgcucgagcgcaagcugaaaaagaugcuggggccuucugcuguugauaucggaaauggcuguuucgaaaccaagcacaaaugcaaccaaacaugccucgacagaaucgccgccgggaccuuuaaugcuggcgaguucagccugcccacguuugauucccuuaacauuaccgccgcuagccugaaugacgauggacucgacaaccauacaauccugcuguauuacucuaccgccgcguccagccuugccgugacacucaugcuggcuauuuucaucgucuauauggugucucgggacaauguuuccuguagcauuugccuguga

SEQ ID NO: 211474 - RNA, 1755 nt, Artificial Sequence; identical to SEQ ID NO: 211313
  derived and/or modified sequence opt5 from hemagglutinin__InfluenzaB__ALE31985

SEQ ID NO: 211475 - RNA, 1758 nt, Artificial Sequence
  derived and/or modified sequence opt5 from hemagglutinin__InfluenzaB__ALE31986
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacauccgccucucuacgcauaacgugauuaaugccgaggacgcuccgggcggccccuauaagaucgggacaagcggauccugcccuaacauuaccaauggcaacggguucuuugccacaauggcuugggccguccccaaaaaugauaagaacaaaaccgcgaccaauccucugacaaucgaagugcccuacauuuguacggagggagaggaccagaucaccguguggggcuuccacagcgauaacgaaacacagauggccaagcuguauggggacucuaagccgcagaaauuuaccuccagcgcuaauggagucacaacccacuacguuucucaaaucggcggcuucccuaaccagacggaggaugggggacugccccaguccggcagaauugugaucgacuauauggugcaaaagagcgggaaaacaggaaccauuaccuaccagcggggcauccuccugccucagaaggucuggugcgccucugggcgcuccaaagugauuaagggaagccuuccccugaucggcgaagcugauugucuccaugagaaauauggcgggcugaacaaguccaagcccuacuacacaggagagcacgccaaagcgguuggcaauugcccuaucugggugaagaccccgcugaaacucgccaacgggacaaaguauagacccccugcuaaacugcuuaaggaacggggauuuuucggcgccauugcuggguuucuggagggcggaugggaaggcaugaucgccggguggcauggauacacgucucacggcgcccacggggucgcuguggcggccgaccucaagagcacccaggaggcuauuaauaaaaucacaaagaaccuuaauucccuuagcgaacuggagguuaaaaaccuccagcgccugucuggagccauggaugagcugcauaaugaaauucucgagcuggacgaaaagguggacgaucuuagagccgacaccaucuccagccaaaucgagcuggcuguccuccugucuaacgaaggcauuaucaauagcgaggaugagcaccuucuggcccucgaacggaaacugaagaagaugcuggggcccuccgcgguggagauuggcaacggauguuucgaaacaaaacauaagugcaaucagaccugccucgaccgcaucgcugccggcacguuugaugccggggaguucucucugccuaccuuugacagccuuaacauuacagcugccucccugaaugaugacggacucgauaaccacaccauccugcuguauuacagcacagcugccucuucccuugcggucacccucaugauugccaucuucgugguuuauauggugagcagagacaaugucucuuguuccaucugccuguga

SEQ ID NO: 211476 - RNA, 1755 nt, Artificial Sequence
  derived and/or modified sequence opt5 from hemagglutinin__InfluenzaB__ALE31988
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccaaugggguuacaacccacuacgugagccagaucggagacuucccugaucagacggaggacggcggccugccccaaucugggcggauuguggucgauuauauggugcagaaaccuggaaagacaggcaccaucguuuaccagcgcggggugcuccugccccagaaagucuggugcgcuuccggaagaagcaaggugaucaaaggcucccuuccccugauuggggaagccgacugucuccaugaggaauacggaggccugaacaagucuaaaccuuauuacaccggcaagcacgcgaaggccaucgggaauugcccgauuuggguuaaaacaccccugaagcucgcuaacggaaccaaauaucggccucccgccaagcugcuuaaagagcgcggcuuuuucggggcuaucgccggauuucuggagggcgggugggaaggcaugauugccggauggcacggcuacacaagccauggggcucacggaguggcggucgccgcugaccucaaguccacgcaagaggccaucaacaagaucaccaaaaaucugaacagccuuucugaacuggaggugaagaaucuccagagacuguccggcgccauggaugaacugcauaacgagauucucgagcuggacgaaaaagucgaugaccuucgggcugauacaaucagcucucagauugagcuggccgugcuccugagcaaugaagggaucauuaacuccgaggacgaacaccuucuggcgcucgagcgcaagcugaaaaagaugcugggaccuucugcuguugauaucggcaauggguguuucgagaccaagcacaaaugcaaccaaacaugccucgacagaaucgccgccggcaccuuuaaugcuggagaguucagccugcccacguuugauucccuuaacauuaccgccgcuagccugaaugacgauggccucgacaaccauacaauccugcuguauuacucuaccgccgcguccagccuugccgugacacucaugcuggcuauuuucaucgucuauauggugucucgggacaauguuuccuguagcauuugccuguga

SEQ ID NO: 211477 - RNA, 1758 nt, Artificial Sequence; identical to SEQ ID NO: 211475
  derived and/or modified sequence opt5 from hemagglutinin__InfluenzaB__ALE31989

SEQ ID NO: 211478 - RNA, 1758 nt, Artificial Sequence; identical to SEQ ID NO: 211475
  derived and/or modified sequence opt5 from hemagglutinin__InfluenzaB__ALE31990

SEQ ID NO: 211479 - RNA, 1755 nt, Artificial Sequence; identical to SEQ ID NO: 211313
  derived and/or modified sequence opt5 from hemagglutinin__InfluenzaB__ALE31991

SEQ ID NO: 211480 - RNA, 1758 nt, Artificial Sequence
  derived and/or modified sequence opt5 from hemagglutinin__InfluenzaB__ALE31992
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacgugcgccucucuacgcauaacgucaucaaugccgaggacgcuccgggcggccccuauaagauugggacaagcggauccugcccuaacaucaccaauggcaacggguucuuugccacaauggcuugggccgugcccaaaaaugauaagaacaaaaccgcgaccaauccucugacaauugaagugcccuacaucuguacggagagagaggaccagauuaccgucuggggauuccacagcgauaacgaaacacagauggccaagcuguauggcgacucuaagccgcagaaauuuaccuccagcgcuaaugggguuacaacccacuacgugucucaaaucggaggcuucccuaaccagacggaggauggcgggcugccccaguccggacggaucguggucgacuauauggugcaaaagagcggcaaaacagggaccauuaccuaccagcgcggaauccuccugccucagaagguuuggugcgccucuggcagauccaaagugauuaaggggagccuuccccugaucggagaagcugauugucuccaugagaaauauggcggccugaacaaguccaagcccuacuacacaggggagcacgccaaagcgauuggaaauugcccuaucugggucaagaccccgcugaaacucgccaacggcacaaaguaucggcccccugcuaaacugcuuaaggaacgcggguuuuucggagccaucgcuggcuuucuggaagggggcugggagggaaugauugccggcuggcauggguacacgucucacggagcccacggcguggcuguugcggccgaccucaagagcacccaggaggcuaucaauaaaauuacaaagaaccuuaauucccuuagcgaacuggaggugaaaaaccuccagagacugucuggggccauggaugagcugcauaaugaaauccucgagcuggacgaaaaggucgacgaucuucgggccgacaccauuuccagccaaaucgagcuggcugugcuccugucuaacgaaggaaucauuaauagcgaggaugagcaccuucuggcccucgaacgcaaacugaagaagaugcugggccccuccgcggucgagaucgggaacggcuguuucgaaacaaaacauaagugcaaucagaccugccucgacagaauugcugccggaacguuugaugccggcgaguucucucugccuaccuuugacagccuuaacaucacagcugccucccugaaugaugacgggcucgauaaccacaccauucugcuguauuacagcacagcugccucuucccuugcggugacccucaugaucgccauuuucguuguguauauggucagccgggacaaugugucuuguuccaucugccuguga

SEQ ID NO: 211481 - RNA, 1758 nt, Artificial Sequence; identical to SEQ ID NO: 210889
  derived and/or modified sequence opt5 from hemagglutinin__InfluenzaB__ALE31993

SEQ ID NO: 211482 - RNA, 1758 nt, Artificial Sequence
  derived and/or modified sequence opt5 from hemagglutinin__InfluenzaB__ALE31994
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacggaaacccgggggaagcugugucccaaaugccucaacuguacagaucuggacguggcucuuggacgcccuaagugcaccggcaagauucccucugccagagucagcauccugcacgaggugcggccuguuacauccggguguuuucccaucaugcaugaucgcaccaaaauuagacaacucccuaaucugcugcggggauacgaacacgugcgccucucuacgcauaacgucaucaaugccgaggacgcuccgggcggccccuauaagauugggacaagcggauccugcccuaacaucaccaauggcaacggguucuuugccacaauggcuugggccgugcccaaaaaugauaagaacaaaaccgcgaccaauccucugacaauugaagugcccuacaucuguacggagggagaggaccagauuaccgucuggggcuuccacagcgauaacgaaacacagauggccaagcuguauggggacucuaagccgcagaaauuuaccuccagcgcuaauggaguuacaacccacuacgugucucaaaucggcggcuucccuaaccagacggaggaugggggacugccccaguccggcagaaucguggucgacuauauggugcagaaaagcgggaaaacaggaaccauuaccuaccaacggggcauccuccugccucagaagguuuggugcgccucugggcgcuccaaagugauuaagggaagccuuccccugaucggcgaagcugauugucuccaugagaaauauggcgggcugaacaaguccaagcccuacuacacaggagagcacgccaaagcgauuggcaauugcccuaucugggucagaaccccgcugaagcucgccaacgggacaaaauaucggcccccugcuaagcugcuuaaagaacgcggauuuuucggcgccaucgcuggguuucuggagggcggaugggaaggcaugauugccggguggcauggauacacgucucacggcgcccacgggguggcuguugcggccgaccucaagagcacccaggaggcuaucaauaagauuacaaagaaccuuaauucccuuagcgaacuggaggugaagaaccuccagagacugucuggagccauggaugagcugcauaaugaaauccucgagcuggacgaaaaagucgacgaucuucgggccgacaccauuuccagccaaaucgagcuggcugugcuccugucuaacgaaggcaucauuaauagcgaggaugagcaccuucuggcccucgaacgcaagcugaaaaagaugcuggggcccuccgcggucgagaucggcaacggauguuucgaaacaaagcauaaaugcaaucagaccugccucgacagaauugcugccggcacguuugaugccggggaguucucucugccuaccuuugacagccuuaacaucacagcugccucccugaaugaugacggacucgauaaccacaccauucugcuguauuacagcacagcugccucuucccuugcggugacccucaugaucgccauuuucguuguguauauggucagccgggacaaugugucuuguuccaucugccuguga

SEQ ID NO: 211483 - RNA, 1755 nt, Artificial Sequence; identical to SEQ ID NO: 211472
  derived and/or modified sequence opt5 from hemagglutinin__InfluenzaB__ALN39719

SEQ ID NO: 211484 - RNA, 1755 nt, Artificial Sequence; identical to SEQ ID NO: 211313
  derived and/or modified sequence opt5 from hemagglutinin__InfluenzaB__ALN39720

SEQ ID NO: 211485 - RNA, 1755 nt, Artificial Sequence; identical to SEQ ID NO: 211313
  derived and/or modified sequence opt5 from hemagglutinin__InfluenzaB__ALN39721

SEQ ID NO: 211486 - RNA, 1755 nt, Artificial Sequence; identical to SEQ ID NO: 211313
  derived and/or modified sequence opt5 from hemagglutinin__InfluenzaB__ALN39723

SEQ ID NO: 211487 - RNA, 1755 nt, Artificial Sequence; identical to SEQ ID NO: 211313
  derived and/or modified sequence opt5 from hemagglutinin__InfluenzaB__ALN39724

SEQ ID NO: 211488 - RNA, 1755 nt, Artificial Sequence; identical to SEQ ID NO: 211476
  derived and/or modified sequence opt5 from hemagglutinin__InfluenzaB__ALN39725

SEQ ID NO: 211489 - RNA, 1755 nt, Artificial Sequence
  derived and/or modified sequence opt5 from hemagglutinin__InfluenzaB__ALN39726
augaaggccaucauugugcugcucauggucguuaccagcaacgcugacagaaucugcacaggcauuacguccucuaauagcccccacguggugaaaaccgccacacagggggaagucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugcggccuguuaccuccggguguuuucccaucaugcacgaccgcacgaagaucagacaacucccuaaucugcugcggggauaugagaagauucgccucucuacacagaacgugaucgaugcugaaaaagccccgggcggccccuacagacuggggaccagcggauccugcccuaaugcuacaagcaagauuggcuucuuugccaccauggcgugggccguccccaaagacaacuauaagaaugcuaccaacccucagacaguggaggugcccuacaucuguacggaaggggaggaucagauuaccgucuggggauuccauucugacaauaaaacacaaaugaagucccuuuauggcgauagcaacccgcagaaguuuaccucuuccgccgacgggguuacaacccacuacgugagccagaucggagauuucccugaccagacggaggauggcggccugccccaaucugggcggauuguggucgacuauaugaugcagaaaccuggaaagacaggcaccaucguguaccagcgcgggguucuccugccccagaaaguguggugcgcuuccggaagaagcaaggucaucaaaggcucccuuccccugauuggggaagccgacugucuccaugaggaauacggaggccugaauaagucuaaaccuuauuacaccggcaagcacgcgaaggccaucgggaacugcccgauuugggugaaaacaccccugaagcucgcuaauggaaccaaauaucggccucccgccaagcugcuuaaagagcgcggcuuuuucggggcuaucgccggauuucuggagggcgggugggaaggcaugauugccggauggcacggcuacacaagccauggggcucacggaguugcgguggccgcugaucucaaguccacgcaagaggccaucaacaagaucaccaaaaaccugaauagccuuucugaacuggaggucaagaaccuccagagacuguccggcgccauggacgaacugcauaaugagauucucgagcuggaugaaaaaguggacgaucuucgggcugacacaaucagcucucagauugagcuggccguccuccugagcaacgaagggaucauuaauuccgaggaugaacaccuucuggcgcucgagcgcaagcugaaaaagaugcugggaccuucugcuguggacaucggcaacggguguuucgagaccaagcacaaaugcaaucaaacaugccucgauagaaucgccgccggcaccuuuaacgcuggagaguucagccugcccacguuugacucccuuaauauuaccgccgcuagccugaacgaugacggccucgacaaucauacaauccugcuguauuacucuaccgccgcguccagccuugccguuacacucaugcuggcuauuuucaucguguauauggucucucgggauaacguguccuguagcauuugccuguga

SEQ ID NO: 211490 - RNA, 1755 nt, Artificial Sequence; identical to SEQ ID NO: 211476
  derived and/or modified sequence opt5 from hemagglutinin__InfluenzaB__ALN39727

SEQ ID NO: 211491 - RNA, 1755 nt, Artificial Sequence; identical to SEQ ID NO: 211313
  derived and/or modified sequence opt5 from hemagglutinin__InfluenzaB__ALN39728

SEQ ID NO: 211492 - RNA, 1755 nt, Artificial Sequence; identical to SEQ ID NO: 211313
  derived and/or modified sequence opt5 from hemagglutinin__InfluenzaB__ALN39729
